United States Patent 11,446,398 (REGULATED BIOCIRCUIT SYSTEMS) - sequence listing, part 89

SEQ ID NO: 196441 - DNA, 2639 bp, Homo sapiens
  Payload ID: 18756
  Gene Name: tumor protein p53
  Uniprot ID: P04637
  ENST ID: ENST00000610292
  CDS Start-End: 368-1432
ctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 196442 - DNA, 2404 bp, Homo sapiens
  Payload ID: 18756
  Gene Name: tumor protein p53
  Uniprot ID: P04637
  ENST ID: ENST00000510385
  CDS Start-End: 279-908
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 196443 - DNA, 2580 bp, Homo sapiens; identical to SEQ ID NO: 196432
  Payload ID: 18756
  Gene Name: tumor protein p53
  Uniprot ID: P04637
  ENST ID: ENST00000610538
  CDS Start-End: 251-1174

SEQ ID NO: 196444 - DNA, 2271 bp, Homo sapiens
  Payload ID: 18756
  Gene Name: tumor protein p53
  Uniprot ID: P04637
  ENST ID: ENST00000504937
  CDS Start-End: 279-1064
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 196445 - DNA, 2404 bp, Homo sapiens; identical to SEQ ID NO: 196442
  Payload ID: 18756
  Gene Name: tumor protein p53
  ENST ID: ENST00000618944
  CDS Start-End: 360-908

SEQ ID NO: 196446 - DNA, 2579 bp, Homo sapiens; identical to SEQ ID NO: 196428
  Payload ID: 18756
  Gene Name: tumor protein p53
  Uniprot ID: P04637
  ENST ID: ENST00000620739
  CDS Start-End: 308-1372

SEQ ID NO: 196447 - DNA, 2653 bp, Homo sapiens; identical to SEQ ID NO: 196430
  Payload ID: 18756
  Gene Name: tumor protein p53
  Uniprot ID: P04637
  ENST ID: ENST00000622645
  CDS Start-End: 251-1159

SEQ ID NO: 196448 - DNA, 2724 bp, Homo sapiens
  Payload ID: 18756
  Gene Name: tumor protein p53
  Uniprot ID: P04637
  ENST ID: ENST00000617185
  CDS Start-End: 203-1228
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 196449 - DNA, 2506 bp, Homo sapiens; identical to SEQ ID NO: 196431
  Payload ID: 18756
  Gene Name: tumor protein p53
  Uniprot ID: P04637
  ENST ID: ENST00000619485
  CDS Start-End: 254-1318

SEQ ID NO: 196450 - DNA, 1149 bp, Homo sapiens
  Payload ID: 18756
  Gene Name: tumor protein p53
  ENST ID: ENST00000615910
  CDS Start-End: 1-1149
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgtcttgcaagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactga

SEQ ID NO: 196451 - DNA, 2271 bp, Homo sapiens; identical to SEQ ID NO: 196444
  Payload ID: 18756
  Gene Name: tumor protein p53
  ENST ID: ENST00000619186
  CDS Start-End: 360-1064

SEQ ID NO: 196452 - DNA, 2331 bp, Homo sapiens; identical to SEQ ID NO: 196440
  Payload ID: 18756
  Gene Name: tumor protein p53
  Uniprot ID: P04637
  ENST ID: ENST00000504290
  CDS Start-End: 279-923

SEQ ID NO: 196453 - DNA, 1883 bp, Homo sapiens
  Payload ID: 18756
  Gene Name: tumor protein p53
  ENST ID: ENST00000635293
  CDS Start-End: 261-1493
tctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagggaatgccaaacactctccccaggagatccagacccgcctctttcagagacttttaacttaaacatctgtccctacccagcaggcaaactagagctcctgaagctcagtccctgtccttgcctctgtagacaggtcaccttgatgagcttcctttttttttttttaatttttttttattttaggctttattggggcataattgatcccccaaaattgcatacattcaaggtatgcagtgtgatgatttgatatgggggtatattgtgaaaccattaccacaatcaaattaatcagcacgtccatcatcacacacagttaccatttgtgtgtgtgcacgtgtgttcacctacgacgaggacacttggacctactctgcagatctcaagtaaacagaaaatctccctttttgacaaccatcctccaccctttcaatcccaaccttttcctagattatgtccctagctctgtttttatttctgctgtgctgcttcagatccattctgactctgccaaacccttctttgcgtgagccactgcgcctggccacaacaccccatttctattttaataaaataaaatactgtgaaaaacatttacaatttttaaattttaattttaaaattaaacttatatttattc

SEQ ID NO: 196454 - DNA, 6346 bp, Homo sapiens
  Payload ID: 18757
  Gene Name: tumor protein p53 binding protein 1
  Uniprot ID: Q12888
  ENST ID: ENST00000263801
  CDS Start-End: 254-6172
gaggggagccatcttgtccctctctgcctccgagtttgtatcgttgcctccatctgtgtctgtgtgtctgtattatcgttgtttggcgtgtttttttttttttttgttttttgtcactgcctgcctgggtcctgcccgaggtctccatcctcggtttccctgtccttgccccgggccctgggagtgctctggaaggctgcgcagtattggaggggacagaatgaccttccggccttgagtccctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactggg

SEQ ID NO: 196455 - DNA, 6015 bp, Homo sapiens
  Payload ID: 18757
  Gene Name: tumor protein p53 binding protein 1
  ENST ID: ENST00000382039
  CDS Start-End: 63-5846
ctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaa

SEQ ID NO: 196456 - DNA, 10384 bp, Homo sapiens
  Payload ID: 18757
  Gene Name: tumor protein p53 binding protein 1
  Uniprot ID: Q12888
  ENST ID: ENST00000382044
  CDS Start-End: 129-6062
gtgacgggaaagggggagttcgcggccggtggcggcggtggcgacagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaactgggatttcttcatctgtttttttgagcttaatctcagaacaaatgacaagacatagtactttctctgagtctttcaacaggcttattcacttacggaggacagctggccaaggaaattgaaaagttaagagtgaactttattctgtggcatcattcccaaaaggttattccagggtgtctaaaatgctatgcttgcagaaactcagtttaaggtaggtgaaggcccagattaacagttgtgccaaaagttgagtggaattgggcacagctctgtttcctgacagttaaaaaagacctcatgctctctctctgagctgagatcacagctcacctgtgggtactccccaactcttagagctaaagggagaacgaaaggaccaactgccatgaagggacagtgaccataagcttgatggaatgaccttccgtaagataaacatgggaagcacaagtgagaacacctggaaatgttacacgttctagtcaaagacccaatattattattattattattgtcacaatagctggaagcagttccttcccttcctctggcatcactgatccctgcatggcttctcattctctaaagcaggggtcaacaaggtttttttctgtaaagggtcaaagagtaaatatttcaggctttgtgggccatttgatccatcacaactactcgcctttgctgtgagggcatgaaagcaaccatagacaatgagtaaacaaatgggcatggctgtgtttcagtaaaactgtacaaaaacagacagcaggccatagtttgccagctcctgctccagagacagcagtagaaagggtgatctttagttgataatagcagggaataagttgtcagagcttcccagtgtgtgtagaatatgtagtgatgaaaaccagatgcagtgactataacctgatgccagaacactgcattctttttcagtttggagggcgttgttcagtgaatatttctttttacttacactgatatgaatattgattaccagtgatggctgggccatattaagataacttcaacccctatggtttgtgtaagatgggtaattgggcctgcaatcttcagtatttaaaaatctaacaacttgatctcaattttttcttaaggacctttttcttggagaataatactttttttttttttttttttttttttgagacggaatttcgctcttgttgcccgggctggaatgcaatggcacaatctcagctcactgcagcgtctgcttcccaggttcaagcaattctcctgtctcagcctcctgagtagctgggattacaggcacatgccaccacacctggctaatttttgtatttttagtagaatcgaggtttcatcatgttggtcaggctggtctcaaactcctgacttcaggtgatccgcccgcctcggcctcccaaagtgctgggattacaggtgtgagccaccatgcccggcctaagaaatacttttaagtatattttcattagctagaattgcccaatctgtgtaggtataaattacttggtatagggagagagaaagcctatcttacctgttgctttcttacttggtggtaacatccagcagttagtctatttataaacataattactttttcacatatgaaccataaaatatttaactttctgctctatattgtttgtttaccgctgtatctcccacagcttgaacagtaccaaggtacgtagtaggtgctcaataaatgactattgaataaatgaacatatccaacaaatgttctcaatgtaaaggatcagagatgccacatgttctccttgatgggagagacccttccacatgggaatgatgggaaggagttgtactcctggatgttcagtaactgcttctaggagaaaaggtagagtcctatcactaagccgcagatatttatttgtgtgtggctagaatgggatgttttgaatcttctgttacaaccttgggaacgtggctgttatttcaatttatgagccagaaattttcacatcccgaaactacaaaagagaaaaagagccttattaagtgtcatgctttcccaagactaccttcaaagaaatatgaatcaggataacctgtgatctaaataatgtcatcttaaaactgaagagtttcttttgactcttctgctacaatagcttagaaaaaaatctgcttgcagacattttagagagaaaggacaatgaagtgattttctgaatgggaatgacagacctctgggaagccagctaccactgaatctcggtatcagttttttttaaagtttagagttagaaggggtggtcgcctcctttcacagatgcggaagctagggaccagcaaggcggggtgcccacggctgcacagctagttcatatcagaattgggagtggaaggcccactgcctcccagcatagcaatacataacctagcaaaggacttaacacctatctcactgtcaggttttttagtattttatgatgatgatgacttctactagaaaataacctccattaaaattattaaagatggtcacacctctatctctaagccttacttataaaatgagggtatttggactaaagtcttcttccagttctagaattctacaactcattaaaaagccaccttaaaaagtctactgagttacccaagggttgctcctacctgcccagagttccaccagcctgggtatagtatttgttataatctagtcgtaacagtagttgagccaaatctgagttgatctgatgattccgaacactggagagaatcttgaacaggagtgaagactggcggctaaagccctgcagagagaaggactcagctgtcattccacttcagctcaccaactctccatatggaggatgggggcggagggaggagtttcttggaaaagccttgttcaaaattctacagaaccacctggccttcccacattcctatttctattagttcctaaaatgacttgtaccaaatccatacatgcatgacttcctatgaaagtactctttcatcagtaggaatttagtagctggtttccagttaatgtattttgtcaagtactggggttggggagaacccgttttgattacaagcagataattatctcagtgagatgggggttagttcaaggaagtaaggaggggggaggatgtgaggaagttagaacaacccaatgcttatttgatgggctgaataaactattcaggactgaactatttttgagcactgtgaggtggcacagtattacctgcttcaaaatcaactgataccaacatttttatctttgtatcttatctctgtacgtgtgtgtattgaggaaatgctttactgactcagaggaaagatcatgaattctccattggcaaaaccacctctgtcctttcggcaaggctgcatacttccaggcagacgcaccttcacgagaatgctcagctgggcggctccacgctcatccagtgggcctaggttctgactgaccagcgaacaaaaactgtgacagagatctaggatttcattcaggcagtgaaacacctacccgggaaacagagttggcattaggaaaggaaggaaggtacatccatgaagttaaagtgttaggagaacagtctgattaatagctgatctaattaatagctgacctcccaaatctgacaggatagacactgccacgtgcaaggcctgccagcccctcagacgcacaaaatgcgtaaaacaaatgcatcctttcctggctaagcgagtattactctcttagccctgcaccaaacctccaatctagccacatttaactcttcatttcttagacccgcagagtgtcttcctgcctctgagctgtgagtgttgttccctttgcccgggatgctcttgtttttaataccagttcaagtcccactctctcagtgaagcactcccttccccactatagcctttagtgaaccctcgtttcttgcttctttattatctgtactgttgtccacttggcaattgttcaggcctctgtgttgttactgatttttgtatgtatatatatatatatgtcttgtttttccaactagattgtgagctccttaagggcagagccatgaattatacctctttgtatccccagtgccttgcatacagtaagcactcaataaatatttaatgatgatga

SEQ ID NO: 196457 - DNA, 3143 bp, Homo sapiens
  Payload ID: 18757
  Gene Name: tumor protein p53 binding protein 1
  ENST ID: ENST00000413546
  CDS Start-End: 44-3143
gtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctc

SEQ ID NO: 196458 - DNA, 613 bp, Homo sapiens
  Payload ID: 18757
  Gene Name: tumor protein p53 binding protein 1
  ENST ID: ENST00000434561
  CDS Start-End: 1-492
ctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctgggaggcatgcatgacctgtctgtcatcttagcctcctaatgaacctacgattcagcttctccaggtcaggtgcagtaggggcaggagagtttgtgagcccctgtgagagtggagacaacaccggtgaaccctctg

SEQ ID NO: 196459 - DNA, 6179 bp, Homo sapiens
  Payload ID: 18757
  Gene Name: tumor protein p53 binding protein 1
  Uniprot ID: Q12888
  ENST ID: ENST00000450115
  CDS Start-End: 85-6012
cagcggcgacctagggatcgatctggagggacttggggagcgtgcagagacctctagctcgagcgcgagggacctcccgccgggatgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctgtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagt

SEQ ID NO: 196460 - DNA, 594 bp, Homo sapiens
  Payload ID: 18757
  Gene Name: tumor protein p53 binding protein 1
  ENST ID: ENST00000417342
  CDS Start-End: 1-145
gaccatgtctgtgttgagctgtatctgtgaagccaggcaagagaatgaggctcgaagtgaggatccccccaccacacccatcagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaag

SEQ ID NO: 196461 - DNA, 3976 bp, Homo sapiens
  Payload ID: 18757
  Gene Name: tumor protein p53 binding protein 1
  ENST ID: ENST00000411772
  CDS Start-End: 1-577
cagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattgtcagtgctgggaggtaacaatcatgccgtctggagtctcctgctacctatgcctgatgctggcagatgtgggttggctgagggctcatgcagcatcctttgtccagatgcagaagtggaactgaatcctgttgctcctcttaagaccaggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggcaaccccgtgaaaatcctttccagaatctgaaggtactcttggtatcagaccaacagcagaacttcctggagctctggtctgagatcctcatgactggtggtgcagcctctgtgaagcagcaccattcaagtgcccataacaaagatattgctttaggggtatttgatgtggtggtgacggacccctcatgcccagcctcggtgctgaagtgtgctgaagcattgcagctgcctgtggtgtcacaagagtgggtgatccagtgcctcattgttggggagagaattggattcaagcagcatccaaaatataaacacgattatgtttctcactaaagatacttggtcttactggttttattccctgctatcgtggagattgtgttttaaccaggttttaaatgtgtcttgtgtgtaactggattccttgcatggatcttgtatatagttttatttgctgaacttttatgataaaataaatgttgaatctctttggttgtagtaa

SEQ ID NO: 196462 - DNA, 446 bp, Homo sapiens
  Payload ID: 18757
  Gene Name: tumor protein p53 binding protein 1
  ENST ID: ENST00000434595
  CDS Start-End: 1-446
acaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggcctactgcaaccatccaagtcaatcaggtctgaatgccctgccatcttccccatttgcgttctatgggcatctgctagagcaaacccatgtggaggaatttttggaaattcctcctttcaacaagcagtatacagaatcccagcttcgagcaggagctggctatatccttgaagatttcaatgaagcccagtgtaacacagcttaccagtgtcttctaattgcggatcagcattgtcgaacccggaagtacttcctgtgccttgccagtgggattcct

SEQ ID NO: 196463 - DNA, 556 bp, Homo sapiens
  Payload ID: 18757
  Gene Name: tumor protein p53 binding protein 1
  ENST ID: ENST00000467474
  CDS Start-End: 1-434
gtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgaggtgcagacagggtctccagagagagagagccacagcaggggcagggttgctgacattttaatatcacaggaaaaggggagtaatgggaaatcccccatcctccattaaagataaatcaactacccctcttcactatttgctctcttcctgttttgggtttgtgtgggaagtagggtggagccc

SEQ ID NO: 196464 - DNA, 4651 bp, Homo sapiens
  Payload ID: 18758
  Gene Name: tumor protein p53 binding protein 2
  Uniprot ID: Q13625
  ENST ID: ENST00000343537
  CDS Start-End: 293-3697
gctggggcccgacccgggattagttggtttcggagcggaggagggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctagctgtttactggtttttgtttttgatgtcataaatagaccttgtttaatagtcacaagccgttgggatatcatacccagctgaaaaagaacaaactgcttaacataagtatatgtatcgtaataagagttttttaccagctaagtgattcaatgtaagtggtttttaaaataaaatactgtagagatca

SEQ ID NO: 196465 - DNA, 4741 bp, Homo sapiens
  Payload ID: 18758
  Gene Name: tumor protein p53 binding protein 2
  Uniprot ID: Q13625
  ENST ID: ENST00000391878
  CDS Start-End: 770-3787
gggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgtagagatagagtttcatcatgttggccaggatggtctcgatctcctgaccttgtgatccgcctgcctcggcctcccaaagtgctggattacaggtgtgagccaccacgatcagcctctagtgtttaaaaaagaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctagctgtttactggtttttgtttttgatgtcataaatagaccttgtttaatagtcacaagccgttgggatatcatacccagctgaaaaagaacaaactgcttaacataagtatatgtatcgtaataagagttttttaccagctaagtgattcaatgtaagtggtttttaaaataaaatactgtagagatca

SEQ ID NO: 196466 - DNA, 1841 bp, Homo sapiens
  Payload ID: 18758
  Gene Name: tumor protein p53 binding protein 2
  ENST ID: ENST00000483398
  CDS Start-End: 1-194
aaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcagtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagca

SEQ ID NO: 196467 - DNA, 593 bp, Homo sapiens
  Payload ID: 18758
  Gene Name: tumor protein p53 binding protein 2
  ENST ID: ENST00000464656
  CDS Start-End: 1-194
aaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcagtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaa

SEQ ID NO: 196468 - DNA, 465 bp, Homo sapiens
  Payload ID: 18758
  Gene Name: tumor protein p53 binding protein 2
  ENST ID: ENST00000465119
  CDS Start-End: 275-418
attagttggtttcggagcggaggagggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaa

SEQ ID NO: 196469 - DNA, 701 bp, Homo sapiens
  Payload ID: 18758
  Gene Name: tumor protein p53 binding protein 2
  ENST ID: ENST00000494100
  CDS Start-End: 1-701
aatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatca

SEQ ID NO: 196470 - DNA, 5638 bp, Homo sapiens
  Payload ID: 18759
  Gene Name: tumor protein p53 inducible nuclear protein 1
  Uniprot ID: Q96A56
  ENST ID: ENST00000342697
  CDS Start-End: 409-1131
gggcccgacggcgagcggagcggccgatcagctgttgcgagcgctgcacaacaacaaaaggacttggactggccggcctgggcgcagcgacccgagggctggagccggccccgcgcctgccgtctgggtacctgaacgaggtgcagcgcagcccggccccaccgcagctacctcagcagtcccgccccgcccgcgtccttccccgccgagccggcggccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttacacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 196471 - DNA, 5631 bp, Homo sapiens
  Payload ID: 18759
  Gene Name: tumor protein p53 inducible nuclear protein 1
  Uniprot ID: Q96A56
  ENST ID: ENST00000448464
  CDS Start-End: 364-858
gcacaacaacaaaaggacttggactggccggcctgggcgcagcgacccgagggctggagccggccccgcgcctgccgtctgggtacctgaacgaggtgcagcgcagcccggccccaccgcagctacctcagcagtcccgccccgcccgcgtccttccccgccgagccggcggccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataagactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttacacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 196472 - DNA, 4018 bp, Homo sapiens
  Payload ID: 18760
  Gene Name: tumor protein p53 inducible nuclear protein 2
  Uniprot ID: Q8IXH6
  ENST ID: ENST00000374809
  CDS Start-End: 224-886
cggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatga

SEQ ID NO: 196473 - DNA, 4184 bp, Homo sapiens
  Payload ID: 18760
  Gene Name: tumor protein p53 inducible nuclear protein 2
  Uniprot ID: Q8IXH6
  ENST ID: ENST00000374810
  CDS Start-End: 390-1052
acaatcagctgtttgaacgttccaatttgtgccgtgagccccgccgcagcggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccagggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatga

SEQ ID NO: 196474 - DNA, 477 bp, Homo sapiens
  Payload ID: 18760
  Gene Name: tumor protein p53 inducible nuclear protein 2
  ENST ID: ENST00000451665
  CDS Start-End: 213-477
actcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggaggggcctggactcggtcccgcccgcctccagagcagtcccctggaggacctcctcatcgagcaccccagcatgtccgtttacgtcaccggcagcaccatagtgctagagcccgggtccccttccccgctcccggacgcgg

SEQ ID NO: 196475 - DNA, 442 bp, Homo sapiens
  Payload ID: 18760
  Gene Name: tumor protein p53 inducible nuclear protein 2
  ENST ID: ENST00000414082
  CDS Start-End: 211-442
tcctcccgtgacccggtagccgctgtgtcggggctgggccctggggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcct

SEQ ID NO: 196476 - DNA, 3683 bp, Homo sapiens
  Payload ID: 18761
  Gene Name: tumor protein p53 inducible protein 11
  Uniprot ID: O14683
  ENST ID: ENST00000308212
  CDS Start-End: 578-1147
attacacacttgggtatcaccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 196477 - DNA, 1954 bp, Homo sapiens
  Payload ID: 18761
  Gene Name: tumor protein p53 inducible protein 11
  ENST ID: ENST00000354556
  CDS Start-End: 445-1155
caccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcaaggtggaaactgagtcagacagaggcgaggtgacttgtctgaggtcacagctagtgagtggtgaagccaagattggaacccaggcaatccagcttggaaggacaaaggatggggtctctgaaacatctccagcctcagccctgctcctggccttctctctcatccagacatggctgcagcctctgggctgggactggcctccctacctccccttcaatccagtgcttccctgctgccagaaggagctttccagaaagcacatgtcaccacagccctctcttgctggaacccaacctctacaggagaccaagctgcctcctacagaccacaggacctccaagactcaccatcgccacctcttgttattcctgccctgactttcctatcaccaccatcaaaggagagtcccccagagattacatctcatggcccgggcttgcggagtgctgggctcccagacaaatgcaatcaaaggagacatgtctcctgggaagagcctcccacaacctcaaagccccgaaagccctccgtgtttatgttcttgcttgatccccacaaccgtccagcaaagccagcacagcagagatgattctatttccccaggagtggtgcccagagaagttaagcagtttgcctgagatgacacagccgtgttggagccgtgcttgcttgggatgaactaagtggcgcgcatttgattttactgctgatttcacagctccttcagctaccccaagctgccatcaatgtcccatcaatttcactttgtctgctcctctctgcaatgagctttctcagctctcagcctgtgttcagtaaagagacgttgctggtcttgtgtcacgtctcctcctgcctgaataatgctcgtgtgcagcatgaaggagaggtctctcagaactcaagggcctgaagctcccagaagcttccagatccagaggcaacaggtgtcttccggtcccagggagggcaagtttcctgaacctcgaaggcaggcagacagtggaggcctcccttccttctcacagcatcctccagctccaaggcaggcttcccccaacccccagggcccaggaactgtcatcagagcagaaatcaagcccagtcccaggcctcaccccacagggcatctgccccattgatatttgcttggtaataaatactggagacagaggg

SEQ ID NO: 196478 - DNA, 3381 bp, Homo sapiens
  Payload ID: 18761
  Gene Name: tumor protein p53 inducible protein 11
  Uniprot ID: O14683
  ENST ID: ENST00000395648
  CDS Start-End: 276-845
agtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccgaagtgggaatgatggctccatttcacagatgaggaaaccgagactcagagcacaaggccacacagcaggaagagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 196479 - DNA, 533 bp, Homo sapiens
  Payload ID: 18761
  Gene Name: tumor protein p53 inducible protein 11
  ENST ID: ENST00000527685
  CDS Start-End: 314-533
agagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttct

SEQ ID NO: 196480 - DNA, 602 bp, Homo sapiens
  Payload ID: 18761
  Gene Name: tumor protein p53 inducible protein 11
  ENST ID: ENST00000530035
  CDS Start-End: 366-602
cgcgggccgccagactcggtaagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatg

SEQ ID NO: 196481 - DNA, 571 bp, Homo sapiens
  Payload ID: 18761
  Gene Name: tumor protein p53 inducible protein 11
  ENST ID: ENST00000533937
  CDS Start-End: 384-571
attgttcccggcaggaggagtgcgcggcgcaaacttgcgagttcccccagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtggggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcag

SEQ ID NO: 196482 - DNA, 658 bp, Homo sapiens
  Payload ID: 18761
  Gene Name: tumor protein p53 inducible protein 11
  ENST ID: ENST00000528473
  CDS Start-End: 185-658
gatgtgaggcgtccgagcccggagcctccgcctggcatcagctccacgtagcccagcgccggcacgcgcgaggcccatttggctgactgaggacgcgacaggtactcagcttctttctgcatctcagttgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtcc

SEQ ID NO: 196483 - DNA, 2647 bp, Homo sapiens
  Payload ID: 18761
  Gene Name: tumor protein p53 inducible protein 11
  Uniprot ID: O14683
  ENST ID: ENST00000525680
  CDS Start-End: 230-799
aagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctccc

SEQ ID NO: 196484 - DNA, 556 bp, Homo sapiens
  Payload ID: 18761
  Gene Name: tumor protein p53 inducible protein 11
  ENST ID: ENST00000525683
  CDS Start-End: 263-556
gtgcactccttctttctctctccaccagcacgtctgcgaggaagtgggaatgatggctccatttcacagatgaggaaaccgagactcagagcacaaggccacacagcaggaagagggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgacc

SEQ ID NO: 196485 - DNA, 499 bp, Homo sapiens
  Payload ID: 18761
  Gene Name: tumor protein p53 inducible protein 11
  ENST ID: ENST00000525138
  CDS Start-End: 129-499
cccatgtgaatgaccgtcgagacaggaaaaacctcccagtgacttctgagcggtgatggaggccatcagagggcctgatccccttgcccacagcagcagcttcagacccccgggggaggagcccaggaatgcctccttcttgccacctgctctgccctgacctctcgccctcttcagcacacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagccca

SEQ ID NO: 196486 - DNA, 720 bp, Homo sapiens
  Payload ID: 18761
  Gene Name: tumor protein p53 inducible protein 11
  ENST ID: ENST00000525145
  CDS Start-End: 193-573
cggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggtgagcccccacccccagcccctgagatctggccccgtgtggctccctcagcccttctctggctcaccagaggtgcctcctccatcctggcccctcgtgcaggggcccatctgtcaggctctggggctgcctccgagaacctgactcctacactgccacgcctgtgccttctccaggagcacactagatcccatggcgcttgccttccctgaccagctctatgatgcggtctttgatggagcccaggtgaccagcaagacccccatccgcctctacggcggtgccctcctc

SEQ ID NO: 196487 - DNA, 3703 bp, Homo sapiens
  Payload ID: 18761
  Gene Name: tumor protein p53 inducible protein 11
  Uniprot ID: O14683
  ENST ID: ENST00000533940
  CDS Start-End: 606-1175
agtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggaagtgggaatgatggctccatttcacagatgaggaaaccgagactcagagcacaaggccacacagcaggaagagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaagatttggctgactgaggacgcgacaggtactcagcttctttctgcatctcagttgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaa

SEQ ID NO: 196488 - DNA, 2045 bp, Homo sapiens
  Payload ID: 18761
  Gene Name: tumor protein p53 inducible protein 11
  ENST ID: ENST00000532253
  CDS Start-End: 134-328
actgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccag

SEQ ID NO: 196489 - DNA, 502 bp, Homo sapiens
  Payload ID: 18761
  Gene Name: tumor protein p53 inducible protein 11
  ENST ID: ENST00000528290
  CDS Start-End: 230-502
aagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagggtctggcagttcgtctctgctgtgctcttctccggcattgccatcatggcatctccctgatcatgtggaacgctctctacacggctgagaaggtcatcattcgatggaccctgctcaccgaagcttgctatttcggggtccag

SEQ ID NO: 196490 - DNA, 642 bp, Homo sapiens
  Payload ID: 18761
  Gene Name: tumor protein p53 inducible protein 11
  ENST ID: ENST00000533443
  CDS Start-End: 363-642
agagtcgaaaaggacaggaattcttcatgttctgcccatgtgaatgaccgtcgagacaggaaaaacctcccagtgacttctgagcggtgatggaggccatcagagggcctgatccccttgcccacagcagcagcttcagacccccgggggaggagcccaggaatgcctccttcttgccacctgctctgccctgacctctcgccctcttcagcacaggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatg

SEQ ID NO: 196491 - DNA, 1078 bp, Homo sapiens
  Payload ID: 18761
  Gene Name: tumor protein p53 inducible protein 11
  ENST ID: ENST00000531928
  CDS Start-End: 273-737
gccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccggtctggaagctgggtaggaactgtggcctgaggccggtgtctcccctcagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcaatgctgcgcccacaccccggcctctgatgaagctctctgctggggatgtgctgccatcttgtggccattggtggaatacacccagtgggttggagcttgcagtcgccaccatctgcaaggagcgctcataagtgtgtgcactgcctctgggcgttgtggtacagagatggaggaagcccaggcccagcctctaggaattcacagcctagaggagaggcagatcaattcagtgtctgcaaaacccctcgcaccccccctattttatccccagagccacttctgtttgaaccacttctgtttcctctctaacctgagatgcacacgttaggatttggaattacaatttttaaagctcagcataggtaatatgcctctatttctacgaaatattctatggctccctattgcctacagaataaaggctgagctcctctggagttagggttgctggaataaaataaatgcacaccca

SEQ ID NO: 196492 - DNA, 3567 bp, Homo sapiens
  Payload ID: 18761
  Gene Name: tumor protein p53 inducible protein 11
  Uniprot ID: O14683
  ENST ID: ENST00000616990
  CDS Start-End: 462-1031
attacacacttgggtatcaccgccagccaaagcagtcccttccatttcaggcaccggcctgggcccgggagacaccgcaaggctatttaagatggtgtggtttgcccatctacgttgatcgtcccaagaaaggggcaccgtctgcagaacttgccaggaaagtcatcctgggcggcgcgggccacgccagggtctccccgcgcggcttcctcccccggcgccttctctcgggcgcgcgtgcgccccctgcaggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 196493 - DNA, 195 bp, Homo sapiens
  Payload ID: 18761
  Gene Name: tumor protein p53 inducible protein 11
  ENST ID: ENST00000627720
  CDS Start-End: 1-195
atggcggccaagcagcccccgcctctgatgaagaagcacagccagacggacctcgtgagccgcctgaagacccgcaagatcctcggcgtgggcggggaggatgacgacggggaggtgcatcgctccaagggtctggcagttcgtctctgctgtgctcttctccggcattgccatcatggcgcttgccttccctga

SEQ ID NO: 196494 - DNA, 1530 bp, Homo sapiens
  Payload ID: 18762
  Gene Name: tumor protein p53 inducible protein 13
  Uniprot ID: Q8NBR0
  ENST ID: ENST00000301057
  CDS Start-End: 116-1297
cggacgcgcgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 196495 - DNA, 420 bp, Homo sapiens
  Payload ID: 18762
  Gene Name: tumor protein p53 inducible protein 13
  ENST ID: ENST00000378818
  CDS Start-End: 1-339
gaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagtaga

SEQ ID NO: 196496 - DNA, 664 bp, Homo sapiens
  Payload ID: 18762
  Gene Name: tumor protein p53 inducible protein 13
  ENST ID: ENST00000577934
  CDS Start-End: 1-278
acttaacttttccggcttcgggtttaagacgcgtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggctctaacagttacctcctctcgtagcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccc

SEQ ID NO: 196497 - DNA, 900 bp, Homo sapiens
  Payload ID: 18762
  Gene Name: tumor protein p53 inducible protein 13
  ENST ID: ENST00000581411
  CDS Start-End: 431-900
gcgataccgggggcccactgtctggggaggggcgcgcgcgagcccagggccaacggacgcgcgggcggcgcgggcggcgcgggggcgctggggctggaggggcggggcgcgcgcgctccctcgctggcggagcggctgggcggcgggccgggcccggggccgcttggaatggcgcctcctccgccttcgccccaactgcttctcctggcagccctcgcgaggctcctgggtcccagcgaggtaaggtgacccgctcctgggaaggcctcggcccgcgagctcaaagcgctttgccaaaagttcgtcctggaaggagtggcgcgccgagggggacgcggagttcttccgctggcgggctgggcctggggagagagagggcagggcctcgccgcgtccagcgccccaactcttcgctttggacccacaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctg

SEQ ID NO: 196498 - DNA, 805 bp, Homo sapiens
  Payload ID: 18762
  Gene Name: tumor protein p53 inducible protein 13
  ENST ID: ENST00000582829
  CDS Start-End: 280-805
cggaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggaaaggggccccccgcctgccctactgagccttgcgcgctgacccggttcctacacttaacttttccggcttcgggtttaagacgcgtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtg

SEQ ID NO: 196499 - DNA, 726 bp, Homo sapiens
  Payload ID: 18762
  Gene Name: tumor protein p53 inducible protein 13
  ENST ID: ENST00000583940
  CDS Start-End: 507-726
aattgcaacaagtgggagcagagggtgagaggagccggggccaccagggagggagggcgcgccggcagccggaagggagtggggagggcacgagccggggagagcggtgttggccatggagacgtggggagactggaggccgaggcttggggacccgactgtcatcagggtcttccgccagaccctgggcgctgcgccctcagaggccgatgaaaagaagcagaagggagaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggaaaggggccccccgcctgccctactgagccttgcgcgctgacccggttcctacacttaacttttccggcttcgggtttaagacgcgtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttca

SEQ ID NO: 196500 - DNA, 824 bp, Homo sapiens
  Payload ID: 18762
  Gene Name: tumor protein p53 inducible protein 13
  ENST ID: ENST00000580183
  CDS Start-End: 269-824
gacgcgcgcctgccaccgctgggcgacggcggaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggaaaggggccccccgcctgccctactgagccttgcgcgctgacccggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgccc

SEQ ID NO: 196501 - DNA, 1050 bp, Homo sapiens
  Payload ID: 18762
  Gene Name: tumor protein p53 inducible protein 13
  ENST ID: ENST00000578749
  CDS Start-End: 466-1050
gggcgacggcggaggtggggaagacagcagcctctcggctagctccggcctcccggggcttctgggtttggagagtttggggagcggagacacctcccgaggctcctccgcgttggaccctatttgcgagggcgggagcggggtgggccgacggcgaagctccagaggtgggaccctctcccttcagcagctcttcctgacttcatgattctgcccctcttctcattgcaggtcacaccgacaaatctgaagcgggtttgccaggggagtgtacccgtctccccagcctgggccacccggtccacagggattccatttccggccttacactccgctccacgatctcatccaggcgctgcagctgtgcagctgctctacagactgcagggacctgctgagacgaatccccggacgaggaaaggggccccccgcctgccctactgagccttgcgcgctgacccggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctg

SEQ ID NO: 196502 - DNA, 1998 bp, Homo sapiens
  Payload ID: 18763
  Gene Name: tumor protein p53 inducible protein 3
  Uniprot ID: Q53FA7
  ENST ID: ENST00000238721
  CDS Start-End: 856-1854
cttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggagtaagtaactcatacgggcgccggggacccgggtcgggctgggggcttccaactcagagggagtgtgatttgcctgatcctcttcggcgttgtcctgctctgccgcatccagccctgtaccgccatcccacttcccgccgttcccatctgtgttccgggtgggatcggtctggaggcggccgaggacttcccaggcaggagctcggggcggaggccgggtccgcggcagaccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtcctgtcctgccctgccctgccctgtgtcctcagacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactgg

SEQ ID NO: 196503 - DNA, 1635 bp, Homo sapiens
  Payload ID: 18763
  Gene Name: tumor protein p53 inducible protein 3
  Uniprot ID: Q53FA7
  ENST ID: ENST00000335934
  CDS Start-End: 491-1489
aacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaatctgatttgcttgcttctaactttgcgttttaaagggggaaggaggaaaggaaagagggggagggtggttctgcttagccccacccctccggctaccccaggtccagccgtccattccggtggaggcagaggcagtcctggggctctggggctcgggctttgtcaccgggacccgcaggagccagaaccactcggcgccgcctggtgcatgggaggggagccgggccaggaacaatatgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtgctggagttaatcttattctagactgcataggcggatcctactgggagaagaacgtcaactgcctggctcttgatggtcgatgggttctctatggtctgatgggaggaggtgacatcaatgggcccctgttttcaaagctactttttaagcgaggaagtctgatcaccagtttgctgaggtctagggacaataagtacaagcaaatgctggtgaatgctttcacggagcaaattctgcctcacttctccacggagggcccccaacgtctgctgccggttctggacagaatctacccagtgaccgaaatccaggaggcccataagtacatggaggccaacaagaacataggcaagatcgtcctggaactgccccagtgaaggaggatggggcaggacaggacgcggccaccccaggcctttccagagcaaacctggagaagattcacaatagacaggccaagaaacccggtgcttcctccagagccgtttaaagctgatatgaggaaataaagagtgaactggaa

SEQ ID NO: 196504 - DNA, 747 bp, Homo sapiens
  Payload ID: 18763
  Gene Name: tumor protein p53 inducible protein 3
  Uniprot ID: Q53FA7
  ENST ID: ENST00000407482
  CDS Start-End: 1-747
atgttagccgtgcactttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaagtacaagcaaatgctggtgaatgctttcacggagcaaattctgcctcacttctccacggagggcccccaacgtctgctgccggttctggacagaatctacccagtgaccgaaatccaggaggcccataa

SEQ ID NO: 196505 - DNA, 677 bp, Homo sapiens
  Payload ID: 18763
  Gene Name: tumor protein p53 inducible protein 3
  ENST ID: ENST00000413037
  CDS Start-End: 1-651
tttgacaagccgggaggaccggaaaacctctacgtgaaggaggtggccaagccgagcccgggggagggtgaagtcctcctgaaggtggcggccagcgccctgaaccgggcggacttaatgcagagacaaggccagtatgacccacctccaggagccagcaacattttgggacttgaggcatctggacatgtggcagagctggggcctggctgccagggacactggaagatcggggacacagccatggctctgctccccggtgggggccaggctcagtacgtcactgtccccgaagggctcctcatgcctatcccagagggattgaccctgacccaggctgcagccatcccagaggcctggctcaccgccttccagctgttacatcttgtgggaaatgttcaggctggagactatgtgctaatccatgcaggactgagtggtgtgggcacagctgctatccaactcacccggatggctggagctattcctctggtcacagctggctcccagaagaagcttcaaatggcagaaaagcttggagcagctgctggattcaattacaaaaaagaggatttctctgaagcaacgctgaaattcaccaaaggtaaacaactgcttctacagttcagcaggaatttaagagatgattaaataaaagccccaccagtctcaaagtt

SEQ ID NO: 196506 - DNA, 777 bp, Homo sapiens
  Payload ID: 18764
  Gene Name: tumor protein p53 regulated apoptosis inducing protein 1
  Uniprot ID: Q9HCN2
  ENST ID: ENST00000458238
  CDS Start-End: 211-471
ccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacagtgcagtaagagcttgcctggcctgtgtgcagagctgcctcatcctgaaattctgggagttgaaagccccagggcaacccttaaccaatgggggaaaagcattggtgtgtaaatcccccagcttccctgggtgggctgcagctgagccatagtctacatgacacttccgaggatccccagtgggcatgacctcaatcgcccacattggatgccacaacctgcactggcttttctcccttccctgtgggtctctctctgcacttcctcccttgtgcattctaggttcaccttccaaataaatgatgtgcactcagg

SEQ ID NO: 196507 - DNA, 806 bp, Homo sapiens
  Payload ID: 18764
  Gene Name: tumor protein p53 regulated apoptosis inducing protein 1
  Uniprot ID: Q9HCN2
  ENST ID: ENST00000531399
  CDS Start-End: 211-585
ccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacaggccttggtctaggtctctccaggcctttccttcctggagccacagtgcttagagacaggccactggggtcagcatttgagctcagctatgatcagaaaaaagcaccgttgaggttgcagtgagccgagatcacgccactgcactccagcctgggcgacagagagagactccatctcaaaacaaaaacaaacaaacaaacagaaagcaccgtcgagaaatggctccagcgctgactagcggccacctcatttccccccttgaccactgggccagttgggtggctaggttgcctcattttgcatccttctgtatccccaaatctgaaataaaagctggaaaaaaa

SEQ ID NO: 196508 - DNA, 363 bp, Homo sapiens
  Payload ID: 18764
  Gene Name: tumor protein p53 regulated apoptosis inducing protein 1
  Uniprot ID: Q9HCN2
  ENST ID: ENST00000530777
  CDS Start-End: 1-363
atgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacaggtctctccaggcctttccttcctggagccacagtgcttagagacaggccactggggtcagcatttgagctcagctatgatcagaaaaaagcaccgttgaggttgcagtga

SEQ ID NO: 196509 - DNA, 1538 bp, Homo sapiens
  Payload ID: 18764
  Gene Name: tumor protein p53 regulated apoptosis inducing protein 1
  Uniprot ID: Q9HCN2
  ENST ID: ENST00000527504
  CDS Start-End: 369-695
acatacagcgagctggcccagctcccggccacgtggctcacactgtccgtgctcacccacccgttgccttcacccccagcagcactggttgtgaaaagggtaactgcctgagccaccccaccactgcgggcctgccaaggacaggcaggaactcagccatgccccgcaaggagcccaggggcatctccagggacggctccccagcctatgggctcgctccctgagaggccgtgctcgggctcgcctgctcagctcactccgaaagcctctgctcagacctgcacccagtcacagcagcacagatgtgcaggaggagaccatttccacggaccctccgactcctaggaggcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtaagtccctgcagtgaaaaccgagacggtcttttgcctgccacagccccgggcagactctgctctcaccgtggtgccgacatcccaagttttcagactcaccaggacccagtgacagcatctgggtcctcagagctgcatgcggactgtccccagttcagagcattggacagagctgggaactgacagccctgatcaatagtcccaagaggaaggccagccctcctcctcctcggaatcctgggtttctaggaggcagaaaggttttctgagaaacaaggcttttggaaggaaggtggtgcctggctgcatccagaaagtgagagctaaatggagaggctgaacaaaggacgcatgtggagcgcatggggagggaaggctggggtgcagggctccgggcctgctcttctgcgtccaccccggatcctgcttttgtccagatgggcctcggagcaccagtcacttactccaagaagtcgtttcctgtggccaataatgaagatgacgcactcggaagcttgtgggctctgaggagggggtaaggatgcaggggccatgcattcatcccagcacaggcagcgcatggctccggaagcagacacaggccaggcctgggccaggagtctgccaggagccaggagcgcctacacctccctggaggcccacacttctctccccagaagctcacacgcagcgtctgaggtgcagggcccaggtgtgctggggtgacaaagccccgagctgtggtgatgggagggaggaagcgccggtttatgtctgttctttgggctgatttgctgtctctgtctttgtctctaatgtcctttgcaccactgaccttgaggagccttttgttcctcctgtcccagtttggtttccatgggaacctgagtggcagcgtcatcactttgctgaggtttcagatcccttagttttgggtgcccaagttcacggagggtgccggggaatagaagctctgtcagtctcgtctggatcttggtcctcagcaactgtctggatcctgacagg

SEQ ID NO: 196510 - DNA, 3124 bp, Homo sapiens
  Payload ID: 18764
  Gene Name: tumor protein p53 regulated apoptosis inducing protein 1
  Uniprot ID: Q9HCN2
  ENST ID: ENST00000602346
  CDS Start-End: 683-1009
gtgggaagttggaaaaaataatctgcaaggtaaacaccttcaagtcaatttcaagaggctggctagaaaccgccaggacttcagggggccctgtctcgcgggtctccctgcgccctcagcactttggcttggtataaggccaccttgtccctgaagagaggcctattttaagctgagcaagaaaaggtgagaaagactaaaatcagctttgtgcagagacgccaatttctgctgcacacatggaaacgatgtgcacatacagcgagctggcccagctcccggccacgtggctcacactgtccgtgctcacccacccgttgccttcacccccagcagcactggttgtgaaaagggtaactgcctgagccaccccaccactgcgggcctgccaaggacaggcaggaactcagccatgccccgcaaggagcccaggggcatctccagggacggctccccagcctatgggctcgctccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtaagtccctgcagtgaaaaccgagacggtcttttgcctgccacagccccgggcagactctgctctcaccgtggtgccgacatcccaagttttcagactcaccaggacccagtgacagcatctgggtcctcagagctgcatgcggactgtccccagttcagagcattggacagagctgggaactgacagccctgatcaatagtcccaagaggaaggccagccctcctcctcctcggaatcctgggtttctaggaggcagaaaggttttctgagaaacaaggcttttggaaggaaggtggtgcctggctgcatccagaaagtgagagctaaatggagaggctgaacaaaggacgcatgtggagcgcatggggagggaaggctggggtgcagggctccgggcctgctcttctgcgtccaccccggatcctgcttttgtccagatgggcctcggagcaccagtcacttactccaagaagtcgtttcctgtggccaataatgaagatgacgcactcggaagcttgtgggctctgaggagggggtaaggatgcaggggccatgcattcatcccagcacaggcagcgcatggctccggaagcagacacaggccaggcctgggccaggagtctgccaggagccaggagcgcctacacctccctggaggcccacacttctctccccagaagctcacacgcagcgtctgaggtgcagggcccaggtgtgctggggtgacaaagccccgagctgtggtgatgggagggaggaagcgccggtttatgtctgttctttgggctgatttgctgtctctgtctttgtctctaatgtcctttgcaccactgaccttgaggagccttttgttcctcctgtcccagtttggtttccatgggaacctgagtggcagcgtcatcactttgctgaggtgaaatgcccctggatgccatgaatacctaggggaaaacctgccagagaagaataaaccatccaagagacggcgctgcagggcctcacagtctgcttccatttcctctcaggtttcagatcccttagttttgggtgcccaagttcacggagggtgccggggaatagaagctctgtcagtctcgtctggatcttggtcctcagcaactgtctggatcctgacaggtgtgtgataattacttagtgaattcatgggtgtgggccgtgatagaattaagtgatttgatgtcctctcgataaatccaggtaacgacatagggttttttgagtttgaccctctcctgaaatttgccatctgacaaaatgacatcatggcagagttgtaaactgctgtggatgtattttatttaatttctcaaattaaaataaaaggtaacggtacacttaagagtggtcactacagccaagctaattgacacccactgaactttctggaatgggccataggatgctggacaataggacagatttggaatgagcagtcttccattccaactttagtttctgcaaagctgttgagagcatggagccaggctgcggggtctgggttcaaatcctgactctaccacttaggagctgtgtgtacatgggcaggacaactggcctgcctgagtctcagtgtaggtgtctgtaaaatggaatgataatagcttccatctcacagattcactgtgtgggtaaaatgatagatatgaaatgctaagaacagcacctgtacgtagtatgtcctacatatcttactgttatcattagcatattttgtttattccaagatacatttttgttggcccatttgatatctatgaaatctaaagattttttttcctgtcttgggagatagaataatgatgtgccttacaatggattgtgttttagattcactgaaattcattattgttgtttttatccctggtctgtaacatgatatttggtaaataacaaggactccatacgttttgcaaagagtaaattctctccctccctactgaggccttggtctaggtctctccaggcctttccttcctggagccacagtgcttagagacaggccactggggtcagcatttgagctcagctatgatcagaaaaaagcaccgttgaggttgcagtgagccgagatcacgccactgcactccagcctgggcgacagagagagactccatctcaaaacaaaaacaaacaaacaaacagaaagcaccgtcgagaaatggctccagcgctgactagcggccacctcatttccccccttgaccactgggccagttgggtggctaggttgcctcattttgcatccttctgtatccccaaatctgaaataaaagctgg

SEQ ID NO: 196511 - DNA, 940 bp, Homo sapiens
  Payload ID: 18764
  Gene Name: tumor protein p53 regulated apoptosis inducing protein 1
  Uniprot ID: Q9HCN2
  ENST ID: ENST00000621818
  CDS Start-End: 683-940
gtgggaagttggaaaaaataatctgcaaggtaaacaccttcaagtcaatttcaagaggctggctagaaaccgccaggacttcagggggccctgtctcgcgggtctccctgcgccctcagcactttggcttggtataaggccaccttgtccctgaagagaggcctattttaagctgagcaagaaaaggtgagaaagactaaaatcagctttgtgcagagacgccaatttctgctgcacacatggaaacgatgtgcacatacagcgagctggcccagctcccggccacgtggctcacactgtccgtgctcacccacccgttgccttcacccccagcagcactggttgtgaaaagggtaactgcctgagccaccccaccactgcgggcctgccaaggacaggcaggaactcagccatgccccgcaaggagcccaggggcatctccagggacggctccccagcctatgggctcgctccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacagtccaa

SEQ ID NO: 196512 - DNA, 4909 bp, Homo sapiens
  Payload ID: 18765
  Gene Name: tumor protein p63
  Uniprot ID: Q9H3D4
  ENST ID: ENST00000264731
  CDS Start-End: 90-2132
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattg

SEQ ID NO: 196513 - DNA, 2032 bp, Homo sapiens
  Payload ID: 18765
  Gene Name: tumor protein p63
  Uniprot ID: Q9H3D4
  ENST ID: ENST00000320472
  CDS Start-End: 29-1561
tcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaa

SEQ ID NO: 196514 - DNA, 4668 bp, Homo sapiens
  Payload ID: 18765
  Gene Name: tumor protein p63
  Uniprot ID: Q9H3D4
  ENST ID: ENST00000354600
  CDS Start-End: 142-1902
agagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaa

SEQ ID NO: 196515 - DNA, 1668 bp, Homo sapiens
  Payload ID: 18765
  Gene Name: tumor protein p63
  Uniprot ID: Q9H3D4
  ENST ID: ENST00000392460
  CDS Start-End: 1-1668
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 196516 - DNA, 1251 bp, Homo sapiens
  Payload ID: 18765
  Gene Name: tumor protein p63
  Uniprot ID: Q9H3D4
  ENST ID: ENST00000392461
  CDS Start-End: 1-1251
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctga

SEQ ID NO: 196517 - DNA, 1386 bp, Homo sapiens
  Payload ID: 18765
  Gene Name: tumor protein p63
  Uniprot ID: Q9H3D4
  ENST ID: ENST00000392463
  CDS Start-End: 1-1386
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctga

SEQ ID NO: 196518 - DNA, 1506 bp, Homo sapiens
  Payload ID: 18765
  Gene Name: tumor protein p63
  Uniprot ID: Q9H3D4
  ENST ID: ENST00000449992
  CDS Start-End: 1-1506
atgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 196519 - DNA, 1749 bp, Homo sapiens
  Payload ID: 18765
  Gene Name: tumor protein p63
  Uniprot ID: Q9H3D4
  ENST ID: ENST00000456148
  CDS Start-End: 1-1749
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 196520 - DNA, 2500 bp, Homo sapiens
  Payload ID: 18765
  Gene Name: tumor protein p63
  Uniprot ID: Q9H3D4
  ENST ID: ENST00000437221
  CDS Start-End: 1-1182
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggttta

SEQ ID NO: 196521 - DNA, 2031 bp, Homo sapiens
  Payload ID: 18765
  Gene Name: tumor protein p63
  Uniprot ID: Q9H3D4
  ENST ID: ENST00000440651
  CDS Start-End: 1-2031
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 196522 - DNA, 676 bp, Homo sapiens
  Payload ID: 18765
  Gene Name: tumor protein p63
  ENST ID: ENST00000434928
  CDS Start-End: 127-676
gagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgagtctcgccttgtctcccaggctggagtgcaatggcatgatctcagctcactgcaacctccacctcctgggttcaagtggttctcctttctcagcctcccaagtaggtgggattacaggcacgcgccaccacgcccagctaatttttggcacgacctcagctcactgcaacctccgccttctggattcaagcgattctcctttctcagcctcccaatattccactgaactgaagaaactctactgccaaattg

SEQ ID NO: 196523 - DNA, 2810 bp, Homo sapiens
  Payload ID: 18765
  Gene Name: tumor protein p63
  Uniprot ID: Q9H3D4
  ENST ID: ENST00000418709
  CDS Start-End: 29-1492
tcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggttta

SEQ ID NO: 196524 - DNA, 5479 bp, Homo sapiens
  Payload ID: 18766
  Gene Name: tumor protein p63 regulated 1
  Uniprot ID: Q6ZUI0
  ENST ID: ENST00000345063
  CDS Start-End: 168-995
cttggtgaagtgagattcagactgagtggggtcacagcacagggcactgtcttgcctggctttatctgagccaatcacacctctcctggccactatctgtggtctagccccctttgtgcagaaagagaaagaagagccttgaggaccagcctagtcaggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatatgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatcaaatactgttatcaaatgagtgcctgatcatcaactcaggaaagaagactctaagtcctgttgcttcagctctctaaatgtaggcttttttttttttttttttttaggtcttggtcttcagccctcttatcctgatttattctctcattggggtctcactgtctctagtattttagctaccacttgataaggatgacttccaaatttatattcccattcccaatatttattccaagactcagttttgcatttctgactgctaatcatctatatatcagtgtcccagtggcctcttaattgagcattatcaaaatcctgtggtatttatatggtcccagttatccatccctgaagtctgtcaattttgatttctctaaattccttgccatgacatcctatatatgatcacatctctatacggcttagcattgtattccgatgcccagatgtcaaacttgaagctcattctcttatcaaaattgttcatgtattcctcctttccattcttatagctgtattattagatcaggtttttaattctgctcaaccaattattaccacagcctgttaaatggaatccctactccaaggctgactgtttcaatctatcctacacttggtttctagctcatttacttataccatcttttgttcaaatatatattttttaataacagacctttttcttctaaagaaatcttttgtagaagcagcatatacgaagcagataaaagtaggttcaatgcggttggagtgaagatgagaatgccacaggcatctttctttctaggcctcagaggtgctgcatatggaatgtccatggatcgcagagggttttgaagaccatgttttcaaaaacactgtcttaacactctattgtcattgctcttttccctcttatttcctctttgtctcttcccgacttagatctaattttcaacaacccaggaaattatctcatatgtttgcatctctcaagtttcttttcttttttctttcagagtcttattttatctaaatttatgtagaaaaaaaagctttgaatgttgactacatagacattactacaataagctttttgcctttcccaagactcaaaattgacacatctttgttgatgtttaagttgaaattccagccaacttttttttgacttttatgtgaagtttaaagtcttttctttgaaaagcttgcttcctcaatttcaaagatttgtcctctgatatatttataaacatcaatttaatgcagacattcaaaccctaaaccttgaataactcttattttattttgtctttgtttacttccattaatttttttttctttccctctcttccgcctttacagcacccactttttcttccccccatgatggcaaatattgttatagtccccaaggcagggaacttctattcagactgtaaaaggaaatgttgaaatccatagctgtcctgtcaacagtagtggaatgaaaagtcgttggattgttttggcactggttctgaagcaggcataattggcaaattattataatactgctgcccgaaaatccccatttgcctcaagatagtggcatttattggcagaagcctctgaaatgtccagcacattcttttgagttaccatttaaggatcagcctgacaatcgacttctctctgcacatttgccccctttgtaacctaagccagactgttcccaaatgaccttctaaaggacacagtgcaccatcatcaatggaaacagttcagaaaggatgacaggagggagatgtttcttagttctgagagccagtctgtaacaatgggataagcatttaatggaatcaaagctgttttgcataaagagtgaactcagagacgacaagagggtctttatgaattcccttcacattttgtaaaaactgtcatatataggctatccccttaattgataaatgggatctagaaagcggtattatgaccagagggtgagaagatttaggaatttggatagcagttcaagataagaaagaacttcttatagttataaattttcaatgatggaatgggttgcttctttaaacagtgagcccaccatcacttggtatgttcaaggaaagactagataaagtcgatattgtgagaggaattgctgtatgataccgtttggagaaatgattgacataatcttttaaggccggtgaccctatcattttccaaataattgttgctagtacttagttaattagacccatttttttcttaggaaagagttggatcaatcatgggagaccctgaaaaatttccttacctttcctaaggtttaatttcctcttctgcgaaatggagacaattatattacttttgcttatttcataaagatcttgtgaggattcaatgaaatgaggttaaattcttttattaaacagaaagttttgagtatttgcctagagagtgatgtgacttttgcagcagaaggtgggaaaacatccaagggaactacatttcctccagaaattgtttcttcattaccatcgacctactgattatggttttctcattttacacttggtgttcttacttgggatctttgtccttaagctcaacagggagccacaacccaggggacctatgtgtacacttggagtttttatcagactatcatttgaacttaccactacagtttagcaaatggcatgatgagtttgattgataataggagtagacgcaagatacattaagtagagtacaaagcatttcataaccaaaatgtcatggttggaggtcttcattattcggtctttatctcattcaggaatttccacttgaaaaatctctgataagctttatttcagaaactgcttgaacagctccactgacaaatgcctcactatcttctgatacatcgtaggcagttctgagggtgagaaagttcaaagcagatagatgttttaacacaacaggaggacttttaaacaatcaccaggactcactcctcggtggtcaattgggcctgtttggaggcctgacctttggtcatcttaaggtcatctaaggcagaaaagagaagctcacttataagttggcacttctgaatcatttgccttgaggtccattttttattcagcctttgtttaaaccttcttaggaagccagtttgtagagttctggggataagaaggcagaaaaaccatgtcaattcagtgcttttatttcacagaaaatgaagcaaaggcctagaaactagaaagacatttctcaaaaagaagatggtgaacttttggaaatactgagattagactacattttccaatttctatccctagcccactgctctttccaatataatatctgtattccatgggaaagacatgccatctgaattgatgtatcgtagttgttgagataattttgaaatgagaaaacaatagggcacagtcgtttgggaagaatttccagaaattgccatcattttcttaaaggctaaggacacttatagagctctccgatttcctatctgataaaaaaagcccaaacaaagctgcggaagctggcagagccagcagatattttgtaaggcagcttcacctctgctggcattttgtggggcaggagagggggagggcaaaggtattaaatttaggcttaaaagctcctcagaaattctttacacacaagagaccaagttggagaaaagaagatgacttgtgccaaggggaagaaagagagagactaatgcctgtggttttcaaaggttaacaacaacataaaaaagccaaggtatttgcacagggatgaatgctcattggctcttggccaacaattatacaagggcttgtgcccacatcctgtagctgtggtttagggacgctgctcatgagtgacttcttatgcttagtggcaggaaactttagtcactgatgtgtaaactcacctttggtctgcacctcccacaacgtgctccgaaagcagttaggggactaggcctcttgatttccttgtagataccagttccccagaagctaaggaaaaactctgaggccttggagttactgagagtggaccaatacttgtcttattctacctgattttggcaactgcttagggttcttctgtatccacaaaaaggaattatgatatcctctgctaaaccctctctttagcctcaaagcccaagaccaaaaaaaatgagccatatttcattgcaggcctgctgccaatgtgaaatataaggaataaagtcatgagactgcttctcaaccta

SEQ ID NO: 196525 - DNA, 411 bp, Homo sapiens
  Payload ID: 18766
  Gene Name: tumor protein p63 regulated 1
  ENST ID: ENST00000456832
  CDS Start-End: 12-411
aggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaaaacggatccattaagccagcaccaaggagaacatcttgacactttatggaatttcaaaaagtatgatatgatggcaataaagtggctcttcagcagaa

SEQ ID NO: 196526 - DNA, 616 bp, Homo sapiens
  Payload ID: 18766
  Gene Name: tumor protein p63 regulated 1
  ENST ID: ENST00000425670
  CDS Start-End: 1-451
cattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagtatgcagagactactgctgggaaggatgagtactgaacccagaactgatgaatagcagtgaacgcattatgtgtgccctacaaccatcatgatctacagaccaaccatttgtactcttttcttgtatttctatccatcttttcaaggggatcatgtaaatgaaccaatgttttagcaattaaatttaactttatactctta

SEQ ID NO: 196527 - DNA, 2296 bp, Homo sapiens
  Payload ID: 18766
  Gene Name: tumor protein p63 regulated 1
  Uniprot ID: Q6ZUI0
  ENST ID: ENST00000433971
  CDS Start-End: 1228-2055
agacttgcttcaggttccaacccggtaaggcaaatggagaggctgtcaggagaccagaagtttacctcagctattgcaccgacgcaccacgtgctctggtgcacatccaccgcctcttcctgcctcagtttctccttttgtaaaacaacagcttgtaaaggcctggggatcttctcatccacgggagttttctaaggatgcaggcgaaagaggatctcactctgttgcctaggctggaatgtggtggcatgatcacagctcactgcagccacaaattcctgggctcaagcaatcctcctgcttcagcctcctgagtagctgggactataggcaagcgctactgtgctcagctctcactctctggctgaatgtagaggactctgaaggcttaggcaagaggggagttataaggcaccacagaaccctgaatgactgcatggagcagaacccttcgcaaacctgctcttcaggcctcctttttgagacagctggaaaagattctttctccttttctagcaattacttcctccctccgactcaaatgcctactcagcctctagtattcagtggctgctgcagtttgcggggttcttctccagaccatagatgcctcagtttttgcagtacctggaggtttcaccagtgaaagctctgaaacagcaaagatggcagcctgccctttcctctgggagttccatcctaggggtgtacagaactgttgctggcctgaatacacctgcatgaggtggctgaagactccagttggattatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaagagacaaggagaaggccttaggatctactgggggagtccggaggagcagtctcttctgtcccgctggaacccatggtccactgaagttccttatgctactttcactgagcatcctatgaaatacaccagtgagaaattccttgaaatttgcaagttgtctgggttcatgtctaagcttgttccagctatccagaatgcccacaagaattcaactggatctggaagaggaaagaaactgatggtgttaactgaacccattttgattgagacctacacagggctgatgtcattcattggaaaccgcaacaaacttggctattcccttgcccgtgggagtattggtttttgagagtctttttggtaccataagcatatcatccacagatatgtcactttgaaaattccagtttgacccacgctatttttggactgaaacaattaattatttttaaatgacgctttatgatttagaaatttagtatttccgaaaatttaaaagcttgattggactgatagatacacactttagacctcatacaagaataatcaaattttcttaaaactagaaaataaatgctgctgagcctatc

SEQ ID NO: 196528 - DNA, 1129 bp, Homo sapiens
  Payload ID: 18766
  Gene Name: tumor protein p63 regulated 1
  ENST ID: ENST00000412373
  CDS Start-End: 828-1129
aggcttgaaaaagaggtcaggccccaggagctgggctggagcagtgaggagtgtttcttccaagagaagatgactgcctgagaggattatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggatgtcttccatttggaagcccctttgcttctaagaagttccagagaccatcccaggcccacagagttataaggattcatctgggcactgaagacatttgggacctcagtgaagtttctccgaggccagatggtcacattgattttctggaatcattttgaataaaaatgagcgaggtggtgaacacaatgcaaggctctccacgtactgtctggtattgttcaaccagctccacgactccctgagggcagagatgagcagatgttaatggataaagccaggctgaagaaatgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaa

SEQ ID NO: 196529 - DNA, 2189 bp, Homo sapiens
  Payload ID: 18767
  Gene Name: tumor protein p63 regulated 1-like
  Uniprot ID: Q5T0D9
  ENST ID: ENST00000344579
  CDS Start-End: 24-665
cggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgagcgagaaggttttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaa

SEQ ID NO: 196530 - DNA, 2414 bp, Homo sapiens
  Payload ID: 18767
  Gene Name: tumor protein p63 regulated 1-like
  Uniprot ID: Q5T0D9
  ENST ID: ENST00000378344
  CDS Start-End: 72-890
gggtggtggcggtggctgcggcgacggcggtcgcgtcggcgtcagggtcggggtcggtaaggggtgcggcaatgctgcaactgcgggactcggtggactcggccggtacgagccccacggcggtgctggcggccggcgaggaggtgggggcaggcggcggcccgggcggggggcggccgggggcggggacgccgctgcgccagacactctggcctctcagcatccacgaccccacgcgccgcgcccgcgtcaaggagtacttcgtgttccggcccggcagcatcgagcaggcagtggaggagatccgcgtggtggtgcggcccgtggaggacggcgagatccagggagtgtggctgcttaccgaggtggatcactggaacaatgagaaggagcggctggtgctggtcacggagcagtccctgcttatctgtaaatacgacttcatcagtctccagtgccagcaggtggtgcggatagcgctcaacgcagtagacaccatttcctacggagaattccagtttccccctaaatcgctcaacaagcgagaaggttttgggattcgaattcagtgggacaagcaaagtcgtccttccttcataaacagatggaatccctggtctaccaacgtgccctatgccactttcacagaacacccgatggctggcgcagatgagaagacagcatctctgtgtcagttggaaagcttcaaggctctgttaatccaagctgtcaaaaaagcccaaaaagaaagccctttgccaggacaggcgaatggcgtgctgatcctggagcgccccctgctcatcgagacctacgtgggactcatgtccttcattaacaacgaggcgaaactgggctactccatgaccaggggcaaaataggcttttagccgctgcgttctgggagctcctcccccttctgggagctcctccccctccccagaaggccaagggatgtgggggctgggggactgggaggcctggcagtcttcatgctgccctgctgctgctggaaggatggggatctttcacctttagggatctcagcacaattagaatcgtaaagtgaattctatctatttaattggatattggactctgctcatataagctacagacaaaagccaaaagactctcgctgtccctgtgctgctggtatttcattctctgtaacttcagttctggtgttttccttgagtatctacttggcttctcgtggtttttcccaccccagctgccccagcacgcgggacccatagcacaccccttagcgcttgcctaggttgctgaaaacagggaggcacctggtatctcgagtgcctgcagttgcaagtatgtttacacctggtgtccaattttgtattttaaaatgtaatccatttttacttcagctcatccaaaagcagccagcagaccggttgactgagaccggtctgtggctgtgggccccttggtgacccgctgctcttttggaaatgggtgacctgaagtgacactttttccacaattaacccaagttgtgttaatacttcaggtctgtttcccagacccagaaagctttacagaaaatcattgtaagacaatttattaatttgagaaagtcaccttgacagttctttgcacacaagttttacacctctctggattcgaagtttgtattgtattcatagttaaagggaatcgggtactttgcttgttgaataatgcactttaaaacaaggaaccgtatcaggccagcatggtggctcatgcctgtaatcccagcattttgggaggctcaggcagacaaatcgctctagctcagaagttgcagagcagcctgggcaacatggtgaaacccgtctctaccaaacagacaaaaagcagccaggcgtggtggcacatctgtggtcccagctacttgagaggctgagccaggaggatcgcttgagcccaggaggcggaggttgcagtgagctgagatggcaccacttattgcactccagcccgggcgacagagcgagactccatctaccagatccttatgacgcagctgatgcctgccttggttcctaccactctggtgtagacagaggactttgtccaagtctcacactaaacatgcccgggcttcgatgtgcctggaggatttccccacagggacccacgcacctccctgtatctgcgcagcttgctcgtgtggctggaagcgctgtcgataagcttcacgcactggcttgccagttcttcagctctaggacttgtagctttaagcaaacggtgtggcatgggttgagtgtggccacctgcaggatgtgcagggctgcctcagaagctggctggggactctagcctctgtgttcataaagacattaagaagtggatggatgttgttccttttttgaagttgtcattaaagtaggtgcaacaaccaa

SEQ ID NO: 196531 - DNA, 4854 bp, Homo sapiens
  Payload ID: 18768
  Gene Name: tumor protein p73
  Uniprot ID: O15350
  ENST ID: ENST00000346387
  CDS Start-End: 111-1733
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatg

SEQ ID NO: 196532 - DNA, 2140 bp, Homo sapiens
  Payload ID: 18768
  Gene Name: tumor protein p73
  Uniprot ID: O15350
  ENST ID: ENST00000354437
  CDS Start-End: 111-1610
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 196533 - DNA, 4899 bp, Homo sapiens
  Payload ID: 18768
  Gene Name: tumor protein p73
  Uniprot ID: O15350
  ENST ID: ENST00000357733
  CDS Start-End: 111-1778
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatg

SEQ ID NO: 196534 - DNA, 2062 bp, Homo sapiens
  Payload ID: 18768
  Gene Name: tumor protein p73
  ENST ID: ENST00000378280
  CDS Start-End: 235-1515
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 196535 - DNA, 2117 bp, Homo sapiens
  Payload ID: 18768
  Gene Name: tumor protein p73
  Uniprot ID: O15350
  ENST ID: ENST00000378285
  CDS Start-End: 235-1587
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaacc

SEQ ID NO: 196536 - DNA, 5120 bp, Homo sapiens
  Payload ID: 18768
  Gene Name: tumor protein p73
  Uniprot ID: O15350
  ENST ID: ENST00000378288
  CDS Start-End: 235-1998
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 196537 - DNA, 1831 bp, Homo sapiens
  Payload ID: 18768
  Gene Name: tumor protein p73
  Uniprot ID: O15350
  ENST ID: ENST00000378290
  CDS Start-End: 122-1819
aaggtgtccaggaagccctgctaagcatctgtcagtgtctccagcacagcaggaggctgttacaggtggcgcctgattcacatctgcaggacaggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctg

SEQ ID NO: 196538 - DNA, 5188 bp, Homo sapiens
  Payload ID: 18768
  Gene Name: tumor protein p73
  Uniprot ID: O15350
  ENST ID: ENST00000378295
  CDS Start-End: 156-2066
tgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 196539 - DNA, 1623 bp, Homo sapiens
  Payload ID: 18768
  Gene Name: tumor protein p73
  Uniprot ID: O15350
  ENST ID: ENST00000604479
  CDS Start-End: 1-1623
atggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactga

SEQ ID NO: 196540 - DNA, 1668 bp, Homo sapiens
  Payload ID: 18768
  Gene Name: tumor protein p73
  Uniprot ID: O15350
  ENST ID: ENST00000603362
  CDS Start-End: 1-1668
atggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactga

SEQ ID NO: 196541 - DNA, 4806 bp, Homo sapiens
  Payload ID: 18768
  Gene Name: tumor protein p73
  Uniprot ID: O15350
  ENST ID: ENST00000604074
  CDS Start-End: 156-1367
tgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 196542 - DNA, 1008 bp, Homo sapiens
  Payload ID: 18769
  Gene Name: tumor protein, translationally-controlled 1
  ENST ID: ENST00000309246
  CDS Start-End: 18-584
tcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgtaagtacaaggaagtgggttaaaataaataatgtaaaaaagacattttagatgtgatttgcaattgttttgtgacactgagaatgagttttacagcgttctgaaacatggttttagttttctctttggggatcaagagaattgtgtttcatatgtaaaaaattcttagggtataaaaaggcttagaatcttatttgtggaaaacgttgagtgcagatggggcataataaagtacagtttaggctgggtgtggtggctcacacctgtaatttcagcacttgggacgccgaggtgggtgcatcacctgaggttgggagttcgagaccagcctggccaacatggcgaaaccctatctctgctaaaaatacaaaaattagccaggcatggcagcgggcacctgtaatcccagctaatcgagagcctgaggcaggaaaatcacttaaacctgggaggggggttgcagtgagcagagatc

SEQ ID NO: 196543 - DNA, 948 bp, Homo sapiens
  Payload ID: 18769
  Gene Name: tumor protein, translationally-controlled 1
  Uniprot ID: P13693
  ENST ID: ENST00000379055
  CDS Start-End: 448-864
ccgagcgccgctccggctgcaccgcgctcgctccgagtttcaggctcgtgctaagctagcgccgtcgtcgtctcccttcagtcgccatcatgattatctaccgggacctcatcagccgtgagtcctcactgcactatccttactgccgcacacgggggtctggggtgcgggtgggggcggggaaggcgcagccgtcgcgggcctaggggacgccggcggtcttagccgagcgcggaggggtcggtgcccggggctcgcgcccagctctggtgtgctacggaggggcagatcccgcgtgcggccgccggcgcgggaaatgcgggaaatggcggcgccaggcgcacggtgatgggcggctctgtgtatccggcagacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagac

SEQ ID NO: 196544 - DNA, 1101 bp, Homo sapiens
  Payload ID: 18769
  Gene Name: tumor protein, translationally-controlled 1
  Uniprot ID: P13693
  ENST ID: ENST00000379056
  CDS Start-End: 172-588
atatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtg

SEQ ID NO: 196545 - DNA, 764 bp, Homo sapiens
  Payload ID: 18769
  Gene Name: tumor protein, translationally-controlled 1
  ENST ID: ENST00000379060
  CDS Start-End: 94-576
gtttcaggctcgtgctaagctagcgccgtcgtcgtctcccttcagtcgccatcatgattatctaccgggacctcatcagccgtgaacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaa

SEQ ID NO: 196546 - DNA, 4735 bp, Homo sapiens
  Payload ID: 18769
  Gene Name: tumor protein, translationally-controlled 1
  Uniprot ID: P13693
  ENST ID: ENST00000530705
  CDS Start-End: 302-820
ggaacggagccttgtgtctccgcctcaagtccccggatgctcacctccccgactcgcccccgctgtggccccgcccccgcgcggctcttcgtgccacgtcaccgcctgcgtcgcttccggaggcgcagcgggcgatgacgtagagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgctatctgctgctatggtttccaccacagatgcaagaagaacatgtccttgcgctttccgtctgtctaattgtggcagctgagattgaatagaggaatacaggaggaaaaaaagcgggaagagtttttgaggcaggtcggtcacccaggcttgtagtgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctatcagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagatactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttggccttctaaagtgttgggattacaggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgcagaagaggtatttccccagttgtcctttcagtgctcttagctgttttcccaacatccagatccaatcaaggctgggacatagcattttatcatgtctatttaagtcagaagtgatgaaccccagctgtttacctcatggtaaacctttgaagattccaggtagaatcttctcagactttgaagactgtctcattttatatctttttctcgttattcctagggtcaagacgttttgggcaagaataaggatgtgaacatcagaaagctcataacattttgtttttgatgctaagtttaacaaaggcatgctttagtagcctgtgggccctagggtttgttaaagtgtggagaacaactgagtggagcaagaggacttttctaggaaggtccttgtaatgtgacatttgaaaacaaatgaaggtgtggaagtaggccatgtggatatcaggacaaaccattccaggccaagacaacagcagttagtctggagtgtgatgtgttctgggaaaaaagtggccactttgctaacccaagaagacaggaagggttgtaaagcagtgggagtgtgcaaggaaggaagaccagacctcaaggaaaccacaggcgctctgagcagaagagttacatgatatgactcaaatttttaaaggatcactttggctgccaggtggcagggtaaaagcatagaataattgtgtataatgtgtttttaaggcaaagatagtggcttagtctagggtagtagactgaggtggtaggaaatgaagatagagacaacaggatatgctggtgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataaggtcatttggagagaggatagactgcattccaacatgagattggttgacaaagagaaaccaacaaaggtaattaagaggtgctcccactgcacttgtactcagaaggctgaggtaggattgttagaggccagcctgggcaccacagggagaccccatctctaaaatttagccaggaaccatggctcatgcctgtagccccaggaatttgggaggctgagtggggaggatcgcttgaggtcaggagtttgagaccagcctgggcaacatagggagacctaaaaaaattaattgggcatctgtagtcccagctactcaggcggctgagctgagaggatggcttgagtccgagagattgagggtgcagtgagctgtgatcataccactgcactccagcctgggcggcagtgagacactatctgaaaaaagtttaaaaattttaaaaaagaaggaactgcccctgaggtaagaaccaagggagggcctcccagaggtcaggtggaaaaagttttaggaaggaggaagtagtcaacagggttacctgttgcaaagtacttaagtaatatgaggcctgatagtggtaaacttgactaccgttggatttcactagtgggaaaggaagtctaattaaaatgcactcaagagactaacagtcgcaggcatgaaatacaatacaggtacatggttttttattatgtgtgcatctgcttcagtaataggtgtgaattactcatttggatcattaggagtttcaaaatctagttaaatgactagatttttgttgatgtaaattctgtcattctgaactgcagggattgtcagtaacttaactgcaaactaaactggtgataattatggtaaaattgcaagacgagcaataaatctcaaccaacttgagagaacactgataa

SEQ ID NO: 196547 - DNA, 530 bp, Homo sapiens
  Payload ID: 18769
  Gene Name: tumor protein, translationally-controlled 1
  ENST ID: ENST00000530245
  CDS Start-End: 1-232
aatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 196548 - DNA, 731 bp, Homo sapiens
  Payload ID: 18769
  Gene Name: tumor protein, translationally-controlled 1
  ENST ID: ENST00000528619
  CDS Start-End: 1-232
aatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgatgcaaaagaaagaaatccctgcgctttctgtctgtctttgtggcggcccagattgaattggggaatacatctttagcctggaaattaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaa

SEQ ID NO: 196549 - DNA, 613 bp, Homo sapiens
  Payload ID: 18769
  Gene Name: tumor protein, translationally-controlled 1
  ENST ID: ENST00000527226
  CDS Start-End: 128-613
ccgagcgccgctccggctgcaccgcgctcgctccgagtttcaggctcgtgctaagctagcgccgtcgtcgtctcccttcagtcgccatcatgattatctaccgggacctcatcagccgcgcacggtgatgggcggctctgtgtatccggcagacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttcttt

SEQ ID NO: 196550 - DNA, 4814 bp, Homo sapiens
  Payload ID: 18769
  Gene Name: tumor protein, translationally-controlled 1
  ENST ID: ENST00000616577
  CDS Start-End: 216-809
cttcgtgccacgtcaccgcctgcgtcgcttccggaggcgcagcgggcgatgacgtagagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgctatctgctgctatggtttccaccacagatgcaagaagaacatgtccttgcgctttccgtctgtctaattgtggcagctgagattgaatagaggaatacaggaggaaaaaaagcgggaagagtttttgaggcaggtcggtcacccaggcttgtagtgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctatcagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagatactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttggccttctaaagtgttgggattacaggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgcagaagaggtatttccccagttgtcctttcagtgctcttagctgttttcccaacatccagatccaatcaaggctgggacatagcattttatcatgtctatttaagtcagaagtgatgaaccccagctgtttacctcatggtaaacctttgaagattccaggtagaatcttctcagactttgaagactgtctcattttatatctttttctcgttattcctagggtcaagacgttttgggcaagaataaggatgtgaacatcagaaagctcataacattttgtttttgatgctaagtttaacaaaggcatgctttagtagcctgtgggccctagggtttgttaaagtgtggagaacaactgagtggagcaagaggacttttctaggaaggtccttgtaatgtgacatttgaaaacaaatgaaggtgtggaagtaggccatgtggatatcaggacaaaccattccaggccaagacaacagcagttagtctggagtgtgatgtgttctgggaaaaaagtggccactttgctaacccaagaagacaggaagggttgtaaagcagtgggagtgtgcaaggaaggaagaccagacctcaaggaaaccacaggcgctctgagcagaagagttacatgatatgactcaaatttttaaaggatcactttggctgccaggtggcagggtaaaagcatagaataattgtgtataatgtgtttttaaggcaaagatagtggcttagtctagggtagtagactgaggtggtaggaaatgaagatagagacaacaggatatgctggtgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataaggtcatttggagagaggatagactgcattccaacatgagattggttgacaaagagaaaccaacaaaggtaattaagaggtgctcccactgcacttgtactcagaaggctgaggtaggattgttagaggccagcctgggcaccacagggagaccccatctctaaaatttagccaggaaccatggctcatgcctgtagccccaggaatttgggaggctgagtggggaggatcgcttgaggtcaggagtttgagaccagcctgggcaacatagggagacctaaaaaaattaattgggcatctgtagtcccagctactcaggcggctgagctgagaggatggcttgagtccgagagattgagggtgcagtgagctgtgatcataccactgcactccagcctgggcggcagtgagacactatctgaaaaaagtttaaaaattttaaaaaagaaggaactgcccctgaggtaagaaccaagggagggcctcccagaggtcaggtggaaaaagttttaggaaggaggaagtagtcaacagggttacctgttgcaaagtacttaagtaatatgaggcctgatagtggtaaacttgactaccgttggatttcactagtgggaaaggaagtctaattaaaatgcactcaagagactaacagtcgcaggcatgaaatacaatacaggtacatggttttttattatgtgtgcatctgcttcagtaataggtgtgaattactcatttggatcattaggagtttcaaaatctagttaaatgactagatttttgttgatgtaaattctgtcattctgaactgcagggattgtcagtaacttaactgcaaactaaactggtgataattatggtaaaattgcaagacgagcaataaatctcaaccaacttgagagaacactgataa

SEQ ID NO: 196551 - DNA, 1766 bp, Homo sapiens
  Payload ID: 18770
  Gene Name: tumor suppressing subtransferable candidate 1
  Uniprot ID: Q53HC9
  ENST ID: ENST00000382125
  CDS Start-End: 194-1357
gatgacacatccgaaaaataggaagtggccactacggaagctgttctgggccagaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcaatagtaactcttctttctcttgagagtaaaaaatgaaataaaataaatccacgctgcacaggtgctcggctcattctttcaggagctctgccctgtgacccca

SEQ ID NO: 196552 - DNA, 1795 bp, Homo sapiens
  Payload ID: 18770
  Gene Name: tumor suppressing subtransferable candidate 1
  ENST ID: ENST00000398659
  CDS Start-End: 142-1386
agaaagacttccagtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacattttgttgtgtgctgtctctggattcctttggtgctcttgggaagtcagctgcccaactgttcatagcactggcaacctcttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcacgaggacagcgtctatgccgtggactggtcctcggctgacccgtggctgtttgcctccctgagctatgacgggaggctcgtgatcaacagggtgcccagggccctgaagtaccacatcctgctatgactcccgggcctgggttatccaggtcccattgagtggttttcctcttggcagattctcaaacagtcgcagctctttggaggtgactcgtgttccaggtggatccctctctgggagagccgctgttcccttcctgtagcagcagcatttatgaatggggtgaatggggctattgtcgacggcacagctaatgcccgaacccagcccctgtcggcagagacagagccccacattattatgtgaataacaatgttttctgttttaagggtgtcaggagtttcgctttttaaaaaaatgtctgttcctgcaatagtaactcttctttctcttgagagtaaaaaatgaaataaaataaatccacgctgcacaggtgctcggctcattctttcaggagctctgccctgtgacccca

SEQ ID NO: 196553 - DNA, 738 bp, Homo sapiens
  Payload ID: 18770
  Gene Name: tumor suppressing subtransferable candidate 1
  ENST ID: ENST00000406835
  CDS Start-End: 105-368
gggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagaataaagactggaaggaaataggccaaaaaggactaaaaattgagccaagggttatcttcagatgcttttcacaggggatgtgttccaagaccacccagcggatgccaggaaaccttgatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtg

SEQ ID NO: 196554 - DNA, 1771 bp, Homo sapiens
  Payload ID: 18770
  Gene Name: tumor suppressing subtransferable candidate 1
  ENST ID: ENST00000443925
  CDS Start-End: 102-1046
aatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaacttcagacagcaaagtcctgacatgtgcagccgtgtggaggatgccgaaggaattggaatcaggcagccacgagtcccctgatgattcatccagcactgcacagaccctggagctgctctgtcaccttgacaacacagcccatggcaacatggcctgtgtcgtgtgggagccaatgggagatgggaagaaaatcatttccttggctgataaccatatcctgctgtgggatttacaggaaagctcgagccaggctgtgagggaagaatctgaacattctgaaggagcgtgcacggaccctgtgtgtgccatcattcccaggctggaggccttgtggggaagaggaacactggagtcggggaacagggatggccccagacacctgcacctgccacgggcctcactcacagaaggaggacctgccacgagcctcactcaaggaagaaggactcgccacgggcctcactcacagaaggacccgccacgagcctcacgcatggaagaaggacccgccgagtgtttcctgggggaattggggttgagttatgactgcaagaagtcagccatatgccaagcataccagaatgccatggccaaattcattcaacagacactcagtgagctcactttggagagggtaataaggacttttcccaacaaatggtcatttctcactatttttaagtagtccttttaatcagacacagacctcctcatcatataattgggccccctcccaactgacagatgagaagaggaaagctaacgacggaagcagaggaagtgtctgaaggtgacgtggtctgagtgccagatctggggctgtgggtcaggtctgatgccctataaatgagtcccacccgggcacagaggtgctcacggtggctcctgcctgcccagacctctcctgtcctccttcaggtctgtgaggttctcagataacttgctcttatttgagtatcttgaatgatcaataacattttgtcctatgagcatgaatttgatttttggaaaaagttaattggaacaaaatctggtaaataaaataggtcagcaagctttgcaaaagctgattagtggaaaacgggttaaaaccacatgaaaactgatttccttgtaagactcataaaaagacattctgaaatattttgagcagagactgcatcattaaaataaatgtcagctttatagccagggatttcagacaatggccagtgaaatttatgttttggatatttgttttgaaaaagccattatctttaagaaaatatgtagtcagtgatttactaagttgcatattttaatatcatagtataatttaccaagttgcatagttttaatatcataaaactacatgtatagtttgattttgtaaatattggagctcactagcattttcttattagtcttcca

SEQ ID NO: 196555 - DNA, 847 bp, Homo sapiens
  Payload ID: 18770
  Gene Name: tumor suppressing subtransferable candidate 1
  ENST ID: ENST00000455162
  CDS Start-End: 100-276
tgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagtgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaagagcaaggagcccctgcaggacaacgtgatcgccacctacgaggagcac

SEQ ID NO: 196556 - DNA, 647 bp, Homo sapiens
  Payload ID: 18770
  Gene Name: tumor suppressing subtransferable candidate 1
  ENST ID: ENST00000441271
  CDS Start-End: 112-647
gcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccagctgcggagacgactgtaaggtgaagttctgggacacccgaaatgtcaccgaacccgtgaagaccctggaggagcactcccactgggtgtggaacgtccgctacaaccactctcatgaccagctggtcctcacgggcagcagtgacagcagagtcatcctttccaacatggtgtccatctcgtcggagcccttcggccacttggtagacgacgatgacatcagtgaccaggaggaccaccgttctgaagagaa

SEQ ID NO: 196557 - DNA, 594 bp, Homo sapiens
  Payload ID: 18770
  Gene Name: tumor suppressing subtransferable candidate 1
  ENST ID: ENST00000444776
  CDS Start-End: 129-594
gtttggagtcgtttgctgcggggagggaatgaatgggcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaagagacatcatagaatcgtttggcattcttcctgtagctcagagtcccacgattgtctttgtaaacacgttgcaccaggtcttcttcaggggacaggtcgcagcttcagacagcaaagtcctgacatgtgcagccgtgtggaggatgccgaaggaattggaatcaggcagccacgagtcccctgatgattcatccagcactgcacaga

SEQ ID NO: 196558 - DNA, 672 bp, Homo sapiens
  Payload ID: 18770
  Gene Name: tumor suppressing subtransferable candidate 1
  ENST ID: ENST00000435721
  CDS Start-End: 93-491
gcgctgggaacacgcccgcgaggtggggacgcgccggccgtagcgaggtccttagcgtgtgagtggccggggtcgggtcgcttccccgcagcatggaggacgatgcaccagtgatctacgggctggagttccaggcacgtgccttaacacctcaaactgcagaaacagatgccattcggtttttggttgggacgcagtctcttaaatatgataatcagatccatatcatagattttgacgatgaaaacaacattataaataaaaatgtcctcctccatcaagcgggtgaaatctggcatattagcgctagccctgcagacagaggtgtgctgacgacctgctacaacagaatgtcgtgtgggagccaatgggagatgggaagaaaatcatttccttggctgataaccatatcctgctgtgggatttacaggaaagctcgagccaggctgtgctggccagctcagcgtccctggaagggaagggacaactgaagttcacctcaggacggtggagcccacatcataactgcacccaggtggccacagcgaacgacaccaccctccgtggctgggacacccggagcatgagccagatctactgcatagagaatgcccacggacagctggtgcgggaccttgactttaatcccaataagcagtactacttggccag

SEQ ID NO: 196559 - DNA, 1686 bp, Homo sapiens
  Payload ID: 18771
  Gene Name: tumor suppressing subtransferable candidate 4
  Uniprot ID: Q9Y5U2
  ENST ID: ENST00000333256
  CDS Start-End: 444-1433
atgccgtcgtttccggggctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagccaccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctga

SEQ ID NO: 196560 - DNA, 992 bp, Homo sapiens
  Payload ID: 18771
  Gene Name: tumor suppressing subtransferable candidate 4
  ENST ID: ENST00000380992
  CDS Start-End: 524-907
tcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccggaaggtgcacgctctttgtggaatacgactgctcaccccgcacagcaagcagcttataagtggccctcctgcctgatttcagccctgggttcaagccctgggtggctgcttactaccaaaatcgctcagtagctccaagcctgcctgcagagggttggcaccattaaatgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggaagcggagtcgagaccacttccggaacaagagcagcagccccgaggacccaggtgctgaggtctgagagggagatggcccagcctgaccccactggccactgccatcctgctgccttcccagtggggctggtcagggggcagcc

SEQ ID NO: 196561 - DNA, 1544 bp, Homo sapiens
  Payload ID: 18771
  Gene Name: tumor suppressing subtransferable candidate 4
  Uniprot ID: Q9Y5U2
  ENST ID: ENST00000380996
  CDS Start-End: 492-1289
ccctcctcttcctgttcttggtcaattccggtcttgtttccccaacaaatgccgtcgtttccggggctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccgttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagccaccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctgaga

SEQ ID NO: 196562 - DNA, 974 bp, Homo sapiens
  Payload ID: 18771
  Gene Name: tumor suppressing subtransferable candidate 4
  ENST ID: ENST00000437110
  CDS Start-End: 365-974
gcggcgccgaccaagatggagactgccgagcagccttgagccgggctgctcaaggtgatggtcgacaccccactttcctgagagcttgaccctcagatgccagggccttggctgcagattccttgggagctcccggggatcttccagcaaataggagcaaatcttttccccgtggatcaggaagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccagg

SEQ ID NO: 196563 - DNA, 863 bp, Homo sapiens
  Payload ID: 18771
  Gene Name: tumor suppressing subtransferable candidate 4
  ENST ID: ENST00000435795
  CDS Start-End: 526-863
cgaccaagatggagactgccgagcagccttgagccgggctgctcaaggtgatggtcgacaccccactttcctgagagcttgaccctcagatgccagggccttggctgcagattccttgggagctcccggggatcttccagcaaataggagcaaatcttttccccgtggatcaggaaggtgcacgctctttgtggaatacgactgctcaccccgcacagcaagcagcttataagtggccctcctgcctgatttcagccctgggttcaagccctgggtggctgcttactaccaaaatcgctcagtagctccaagcctgcctgcagagggttggcaccattaaatgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggccca

SEQ ID NO: 196564 - DNA, 1423 bp, Homo sapiens
  Payload ID: 18771
  Gene Name: tumor suppressing subtransferable candidate 4
  Uniprot ID: Q9Y5U2
  ENST ID: ENST00000451491
  CDS Start-End: 182-1171
gttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagccaccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctg

SEQ ID NO: 196565 - DNA, 851 bp, Homo sapiens
  Payload ID: 18771
  Gene Name: tumor suppressing subtransferable candidate 4
  ENST ID: ENST00000440813
  CDS Start-End: 229-851
ctcagtagctccaagcctgcctgcagagggttggcaccattaaatgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtgggg

SEQ ID NO: 196566 - DNA, 979 bp, Homo sapiens
  Payload ID: 18771
  Gene Name: tumor suppressing subtransferable candidate 4
  ENST ID: ENST00000485682
  CDS Start-End: 649-979
cgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctg

SEQ ID NO: 196567 - DNA, 912 bp, Homo sapiens
  Payload ID: 18771
  Gene Name: tumor suppressing subtransferable candidate 4
  ENST ID: ENST00000496468
  CDS Start-End: 339-912
ccattaaatgaggtaacgagtcaaaagtccctaccctgggtcctagcctgtcaggggctccgaaaacccaggctcaggtcggtcctgcccggcacctgtttcacacatgtacactccggtctgaggttggtcctctcccccaccccacccacctgcagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctgg

SEQ ID NO: 196568 - DNA, 2052 bp, Homo sapiens
  Payload ID: 18772
  Gene Name: tumor suppressor candidate 1
  Uniprot ID: Q2TAM9
  ENST ID: ENST00000358022
  CDS Start-End: 120-758
gccgccgcccgcgacctcctctcctcctccgtcgtcaccccggccgccctgccagccccgaacttgcccgcgcctggccgcgcggcccctcagcccacggggctggcggcgcggttgggatgggaccgatgtggcgcatgcgtggtggcgccactaggcgcgggagttgctgcggcggggacggtgctgcggacggccgagggccaggccgctccggccgggctcgtggtgggggcagccccagcggcggcggcggcggcgtgggctggcgaggccgcgcggacggcgcccgacagcagctggaggagcggtttgccgacctggcggcgagccacttggaggccatccgtgcgcgggacgagtgggaccggcagaacgcgcggctgcgtcaggagaacgcccggctgcggctcgagaaccggcggctgaagcgcgagaaccgcagcctcttccgtcaggctttgcggctccccggcgaaggcggcaacgggacgcccgcggaggcacgccgggtccctgaagaggccagcacgaaccggagggctagagacagcggccgagaggacgagccgggcagccccagggccctgagggcccgacttgagaagctggaagccatgtaccgccgggccctgctgcagctgcacctcgagcagcggggaccacgtccgagcggggacaaggaggagcagcctctacaggaacccgactccggcctccgctcccgggactcggagccctctgggccctggctgtagccgaggccgcagccggtgagaggcggagcctcgagcgggcccctcctcctccgttcccagctacccccgacctcgcgcacgccctggcccgctccctgcccgcggataccttggactacggtgccttcccgcccccaccagtggacacttccgggtggcgcttggccatccgcttggtggaggtcgagtgggtgcaagggccctcaggacctcccacatgtacagttcccctgcctcttgccccggctagtttccctggagagaggcctagccaacaacgaagggacggattttaaaacagcgagaactgggtgccaagaaacacttcatattccctgaacttttctggatgttgtgcgaacctgttgtatttttttttttcctgtattttggttctgagggatgagtaatgtgtttttagttggttgagtttatccattcttcaatcccctaaagccttcagctattctttcatatgtggccaacattttaagtacagtgtttgcttttataagtcggtgttacttggatgtcctataaaatacccactttttataaagatgatatttataacctaggaactcatgcctgtcttggctgcagtccctgtacatctaatatatactgatttgtttgcccccagagaatttttaaggtatctgcctatatcgtgatcttttgaaatggtaaataaatctggtgcattaaaaattatctgaaaggttgcggcgagtattatttgaagtgtgttacatttttatatttttaaaaagatacctttatgaatatactaatttaaatctggttttagttgtccttagtaaactatcatgttcttttagcttcatgtaacagtgatcttttaaaataatctaaagattaggtagtctaaaagttattttaatctttaatgttcaattagcttaattagtacgtagataatttgccttattttgactaaggacttttaagaaattataaattacttgtatatcaaaagttcccctaacaaagtaatttaagtctcagttgttatttcaatggcacaaaaaagtgactagtttagcaataaatgtcctaaaattacttttattgcgcttcgttaataacacttttgccaactaagtaatgaagaggataccattgtgcctgataaaaaaatcataggtccaagagtgtttcaatgatggaaaacatttcaggggaaaaaatcatgaatagaattgtcaagggaataaaatatactagttatggcatagtccaaaagtattaaatattatatattacaaaacaa

SEQ ID NO: 196569 - DNA, 1691 bp, Homo sapiens
  Payload ID: 18773
  Gene Name: tumor suppressor candidate 2
  Uniprot ID: O75896
  ENST ID: ENST00000232496
  CDS Start-End: 145-477
agtgaggtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgcaca

SEQ ID NO: 196570 - DNA, 561 bp, Homo sapiens
  Payload ID: 18773
  Gene Name: tumor suppressor candidate 2
  ENST ID: ENST00000417867
  CDS Start-End: 97-270
ggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggcttaggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatggtgtgctctgctctatgttctatgatgaggatggggatctggctcacgagttctatgaggagacaatcgtcaccaagaacgggcagaagcgggccaagctgaggcgagtgcataagaatctgattcctcagg

SEQ ID NO: 196571 - DNA, 735 bp, Homo sapiens
  Payload ID: 18773
  Gene Name: tumor suppressor candidate 2
  ENST ID: ENST00000454201
  CDS Start-End: 108-305
gcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatgctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaac

SEQ ID NO: 196572 - DNA, 790 bp, Homo sapiens
  Payload ID: 18773
  Gene Name: tumor suppressor candidate 2
  ENST ID: ENST00000421918
  CDS Start-End: 153-350
gaagcggaagtgaggtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatggtgtgctctgctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaac

SEQ ID NO: 196573 - DNA, 3683 bp, Homo sapiens
  Payload ID: 18774
  Gene Name: tumor suppressor candidate 3
  Uniprot ID: Q13454
  ENST ID: ENST00000382020
  CDS Start-End: 209-1252
gcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacctaacccactatatccattttgctcatgtgttttatgcaaccagctttccatcaaatcctcaatctttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagca

SEQ ID NO: 196574 - DNA, 1627 bp, Homo sapiens
  Payload ID: 18774
  Gene Name: tumor suppressor candidate 3
  ENST ID: ENST00000515859
  CDS Start-End: 205-1035
ttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcact

SEQ ID NO: 196575 - DNA, 1266 bp, Homo sapiens
  Payload ID: 18774
  Gene Name: tumor suppressor candidate 3
  ENST ID: ENST00000509380
  CDS Start-End: 151-1020
ctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgacatcttagcagtatactttatctggataaagtgatgactatcgaaacacatcaggaataccgagctgaaggatgaaaagctgtgttgagatcatccttttattgtatggcaggaattctccaaggtttaatttcatggatcattgacatcaagctgagatttaggattcaaataaatttcacaagcagtgtgaatgttttcatatagatcttagcagtgatacataaaagaattaaaagtctgtattctcttta

SEQ ID NO: 196576 - DNA, 1498 bp, Homo sapiens
  Payload ID: 18774
  Gene Name: tumor suppressor candidate 3
  Uniprot ID: Q13454
  ENST ID: ENST00000503731
  CDS Start-End: 149-1195
cggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggat

SEQ ID NO: 196577 - DNA, 1546 bp, Homo sapiens
  Payload ID: 18774
  Gene Name: tumor suppressor candidate 3
  ENST ID: ENST00000506802
  CDS Start-End: 199-1143
gtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatg

SEQ ID NO: 196578 - DNA, 1203 bp, Homo sapiens
  Payload ID: 18774
  Gene Name: tumor suppressor candidate 3
  ENST ID: ENST00000511783
  CDS Start-End: 1-909
aatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcaggcaaaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttcattctatctaggaaaaatgtagccaaatcttttttcccattaacaaataatgtaagccttaatattcaagggtaataaaaaatacaagtcttccaaa

SEQ ID NO: 196579 - DNA, 1452 bp, Homo sapiens
  Payload ID: 18774
  Gene Name: tumor suppressor candidate 3
  ENST ID: ENST00000510836
  CDS Start-End: 153-983
tcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaact

SEQ ID NO: 196580 - DNA, 3596 bp, Homo sapiens
  Payload ID: 18775
  Gene Name: tumor suppressor candidate 5
  Uniprot ID: Q8IXB3
  ENST ID: ENST00000333813
  CDS Start-End: 340-873
cattcttctctctgctctctgagctttccgttgcttccctgcccatctgtgctctcagcagcaccagcaaagttggcctcaaacttgaacaaagctgcaggctccagcgtctttctgggagctccgcgggggcagcaggcaggccccagcctctgaactcagctggcttgagaagctcagcccaacccttccagcacccagccggccctccgtctcctgagggacgcccctgcccccgacctggaggccctcagtctgggctggggaatggcgcgctgaggtccctccagagccccttgtcccagcctggagctgcagccgcgcaaggcccaggcccccatggcccacccggtgcagtccgagtttccttcagcacaggagccaggctccgccgcattcctggacctgccggagatggagatactcctcaccaaggcagagaacaaggatgacaagaccctgaatctgtccaagaccctctcggggcctctggatctggagcagaacagccagggcctacccttcaaggccatctccgaggggcacctggaggccccactgcctcggtccccctcccgggccagctcaaggagggcgtcctccatcgccaccacctcctatgcccaagaccaagaagcccccagagattacctcatcctggccgtcgtcgcctgcttctgccccgtctggcccctcaacctcatccccctcatcatttccatcatgtctcgaagcagcatgcaacagggcaacgtggacggcgcccggaggctgggccgcctggctcggctgctcagcattaccctcatcatcatgggcatcgtcattatcatggtggccgtgaccgtcaacttcacagttcagaagaaataaacttaagcagggagctgggctagcagaggccggccctggccatcgggagagctctgacctgcacaccgcgggaggccagggtgctgactgtcaagcatcccctgtccccaagttccaaaagcacagactcaaagggaaaccccccagtcacccactgtcagcccccatctgacaagaaagcctggagcgaggaaggaaagcacagcgaacccaatgggtaacgtggtttactctcccggacgcgtcctgggatctcaaccccagcagtctggcttgtttctcattcccacaatttcctgggttccaccaagcagcgaaaactgccaggatgaatgaggaaaaaacccagccccacaaacgagacacacgctggcggggagagacgcagcagagctccttcctgtctgtggactcggagcaaagacgtggggccccatcttttgtgttttcctcaagcggggaaagaatggactgtttgcatgcttcgtgccacacgcccgcggtgatcccagccagggccccgagcgcagaggcggagctgtgctcagcacaggcctgggacctcccccggcaggcacctgtggggggtgcagctcccgggaaggaggcaactgcctcacttaacatcctccgctgcaaggtggtggcgccgagaggcgtgtctgtgaagacaggtaccaggatggcaggacccgcacgcctcttcccacacctgtcagcttcggaagcatctctcgaggactctggtcccaggatgtctcccaggacaagccagtctgcctcttcctcctacttctgctgtagcctgggaccagacctggccaaggtcagccagcggggagggccgaggtctgagctctcgtcctgccgtggcccccgcgatggcctggggtgcaagcttggggctccgtctggtgctgcttaggtagtttcaggcttccagcccagccctatgctctgtgcttggccctgggcccctggccatccacaaacagcagaggccttccctggaggaggctttgggaccacccctggggggacttcccaaagggtcccaggctgtcaggggcgtttgcgccacctgcaagggcgtgggtcagagagtttttatgggggtctgttgtttgaccgtcctgagaccgagggaagggctcagctgaaggaccccgtctgcaggagagtcgggggaccaggtttgggaatacacttgcatgtacagagcctggggcctggacgccacggcctctcatcttaggacctaatgggacccccgaaaggagccaagtggggccctcggcctcttccttcgttccaggcccatgattttccctacacttctccctggcccaggctccagccacaggcacctctcctgcccccgcccaccctcctgaccgcagctcccaggccctggagacctccaggctttcctgccctgggcagccccacctcacagccagagtcaatgccttcatgggaagggctcccagccacacccagagtggcccaaagctgttgaagtcagcatcctttgtcccatcaggaccctcctgcctcctctccaggcccttgttcgcctccccaccctcctcagaggcccggggaagggaagagcaggtcagtacagaggttctgtctacagggaggggccctgggtctatgcacagctggagctctgagccttccacagcccgtgtgactgctagagggcaggggtgcagggctcagggggcccgggctggtcctttggggctggtgttcctacgtcagtccccacctggggaataaactccagcctctcctgctcatacagaagggactggttgggtttgctttatgggatctttgagaccaaaacagatgctcctgtttgctgggggagggtgtgagcacggagtatttctgtccctcgtgaagtcacgtcacacaggggagaggcgaggtcgatggaactggccacgcacaggctctggctctggaaggagggatgatgagtgggcgttttcccggcaggcccccggggtcctcagcctcagcaacccagggagaggacagaaacgaaccgatggttgagggattgtcacgggaggaacatgacacccgaagggactctaggtgccctcggagtgccacacatgcccagaccttctcacacccacacaaataggctctgccgtgcactcctacacacacacacacacacacacacgcttgttcacactcagaacccaggacagccacagccaccgcttaggggaagccactgcagatgcccctggaatgggcacagcacagccagggcgctcttccaggcaggcgaggataacttgagagtttcctagggcaccagggacagagctcagaggcccccgaggtgtgtgtaggaggcggaggcccgcagagcacagagcaggagaagggcttgggccctggaggagaaagccattctggacaccaggggacctggacggagggtccccacagcccgtgccccacgccgcctggaggccagaggggtcagtggccctgctgtcccggctccatcttggttctagccgccacctgcatgaacacagtggcccggcttaacgcactaacccagcctctccctgtgtcccacagggagtagcaagacccaccccacactgccttcaccatctacaccagtgacgccgctgtgtgtcttagcatggaaataaataaacctgaatgtacgtgctcgc

SEQ ID NO: 196581 - DNA, 2737 bp, Homo sapiens
  Payload ID: 18775
  Gene Name: tumor suppressor candidate 5
  ENST ID: ENST00000626647
  CDS Start-End: 1-14
ttcagaagaaataaacttaagcagggagctgggctagcagaggccggccctggccatcgggagagctctgacctgcacaccgcgggaggccagggtgctgactgtcaagcatcccctgtccccaagttccaaaagcacagactcaaagggaaaccccccagtcacccactgtcagctcccatctgacaagaaagcctggagcgaggaaggaaagcacagcgaacccaatgggtaacgtggtttactctcccggacgcgtcctgggatctcaaccccagcagtctggcttgtttctcattcccacaatttcctgggttccaccaagcagcgaaaactgccaggatgaatgaggaaaaaacccagccccacaaacgagacacacgctggcggggagagacgcagcagagctccttcctgtctgtggactcggagcaaagacgtggggccccatcttttgtgttttcctcaagcggggaaagaatggactgtttgcatgcttcgtgccacacgcccgcggtgatcccagccagggccccgagcgcagaggcggagctgtgctcagcacaggcctgggacctcccccggcaggcacctgtggggggtgcagctcccgggaaggaggcaactgcctcacttaacatcctccgctgcaaggtggtggcgccgagaggcgtgtctgtgaagacaggtaccaggatggcaggacccgcacgcctcttcccacacctgtcagcttcggaagcatctctcgaggactctggtcccaggatgtctcccaggacaagccagtctgcctcttcctcctacttctgctgtagcctgggaccagacctggccaaggtcagccagcggggagggccgaggtctgagctctcgtcctgccgtggcccccgcgatggcctggggtgcaagcttggggctccgtctggtgctgcttaggtagtttcaggcttccagcccagccctatgctctgtgcttggccctgggcccctggccatccacaaacagcagaggccttccctggaggaggctttgggaccacccctggggggacttcccaaagggtcccaggctgtcaggggcgtttgcgccacctgcaagggcgtgggtcagagagtttttatgggggtctgttgtttgaccgtcctgagaccgagggaagggctcagctgaaggaccccgtctgcaggagagtcgggggaccaggtttgggaatacacttgcatgtacagagcctggggcctggacgccacggcctctcatcttaggacctaatgggacccccgaaaggagccaagtggggccctcggcctcttccttcgttccaggcccatgattttccctacacttctccctggcccaggctccagccacaggcacctctcctgcccccgcccaccctcctgaccgcagctcccaggccctggagacctccaggctttcctgccctgggcagccccacctcacagccagagtcaatgccttcatgggaagggctcccagccacacccagagtggcccaaagctgttgaagtcagcatcctttgtcccatcaggaccctcctgcctcctctccaggcccttgttcgcctccccaccctcctcagaggcccggggaagggaagagcaggtcagtacagaggttctgtctacagggaggggccctgggtctatgcacagctggagctctgagccttccacagcccgtgtgactgctagagggcaggggtgcagggctcagggggcccgggctggtcctttggggctggtgttcctacgtcagtccccacctggggaataaactccagcctctcctgctcatacagaagggactggttgggtttgctttatgggatctttgagaccaaaacagatgctcctgtttgctgggggagggtgtgagcacggagtatttctgtccctcgtgaagtcacgtcacacaggggagaggcgaggtcgatggaactggccacgcacaggctctggctctggaaggagggatgatgagtgggcgttttcccggcaggcccccggggtcctcagcctcagcaacccagggagaggacagaaacgaaccgatggttgagggattgtcacgggaggaacatgacacccgaagggactctaggtgccctcggagtgccacacatgcccagaccttctcacacccacacaaataggctctgccgtgcactcctacacacacacacacacacacacacgcttgttcacactcagaacccaggacagccacagccaccgcttaggggaagccactgcagatgcccctggaatgggcacagcacagccagggcgctcttccaggcaggcgaggataacttgagagtttcctagggcaccagggacagagctcagaggcccccgaggtgtgtgtaggaggcggaggcccgcagagcacagagcaggagaagggcttgggccctggaggagaaagccattctggacaccaggggacctggacggagggtccccacagcccgtgccccacgccgcctggaggccagaggggtcagtggccctgctgtcccggctccatcttggttctagccgccacctgcatgaacacagtggcccggcttaacgcactaacccagcctctccctgtgtcccacagggagtagcaagacccaccccacactgccttcaccatctacaccagtgacgccgctgtgtgtcttagcatggaaataaataaacctgaatgtacgtgctcgc

SEQ ID NO: 196582 - DNA, 1824 bp, Homo sapiens
  Payload ID: 18776
  Gene Name: tumor susceptibility 101
  Uniprot ID: Q99816
  ENST ID: ENST00000251968
  CDS Start-End: 417-1589
aatcagtcattaaggctcactggcaagcccttcgtacttcttccctctccggcactagcttccttaagtcgactctgtgaaatacctgctaatcttatcctgaaccagagtttcgaccctcggaacagtcttgcccacatctttgggacccgattcgtcctgctgattccggcactcgaggggcgggttggttggaacccaccccaccaggcccctctcaatcccacacggtgtccacccttgcccgcaggacggcggcccggaagtgacgtagtggaagcggaagtggtgtagtggtgccgacttcctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcataa

SEQ ID NO: 196583 - DNA, 2101 bp, Homo sapiens
  Payload ID: 18776
  Gene Name: tumor susceptibility 101
  ENST ID: ENST00000536719
  CDS Start-End: 136-1233
ggaagtggtgtagtggtgccgacttcctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaagtacaaatacagagacctaactgtacgtgaaactgtcaatgttattactctatacaaagatctcaaacctgttttggattcatatgtttttaacgatggcagttccagggaactaatgaacctcactggaacaatccctgtgccttatagaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacccacagtcagacttgttggggcttattcaggtcatgattgtggtatttggagatgaacctccagtcttctctcgtcctatttcggcatcctatccgccataccaggcaacggggccaccaaatacttcctacatgccaggcatgccaggtggaatctctccatacccatccggataccctcccaatcccagtggttacccaggctgtccttacccacctggtggtccatatcctgccacaacaagttctcagtacccttctcagcctcctgtgaccactgttggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaagacttcagtgccctgaacggttagagaaattaatgaaggagctccaccaggtgccttcacaactctgagtcatatcagaatctctccacagctctcctttcaaaaatgacaccgtgacatttcaggatgtgaaaaaacttactggaaagtgtgtaagaaaatataaaatactattgtacaatgtgataatgtatcatcagcttgttattttcagtgtgcttccttgtagcgccggactaccatttctgaattttggatttggtattttttttaaagaatcaaactcttaaaagaggaaatgcttataccaatagcctgtatgaagcaaaatttatgtgaaagctaaagatatgcatgcagttaaatatataaataaatctcaatgccatacaaaaagaacttttgataatctatgaactattttaaaaaagaaaaaacagcctcaaacttatgggataccgttaaacacaccaacatatatatgcatgtatggtaggaccagaaggaagggagaggagcagaaaattattcaaagaagtaacagctgaaacttcccaaatagaaaaacattatacatccaagccgggtgcagtggctcatgcctgtagtcccagcactttgggaggctgaggtgggcagatcagttcgggtcaggagttcaagaccagcctggccaacatggagaaaccccgtctctactaaaaatacaaaaagttagccaggagtggtggtgggtgcccataatcccagctactcaggaggctgaggcacaagaatcacttgaatccaggaggcggaggttgcaatgagccgagatcatgccactgcactccagtctgggccacagggcaagactccatctcaaaaaaagaaaaaaaaaaaaa

SEQ ID NO: 196584 - DNA, 912 bp, Homo sapiens
  Payload ID: 18776
  Gene Name: tumor susceptibility 101
  ENST ID: ENST00000584526
  CDS Start-End: 1-232
cgatgaagttatcattcccacagctcccttatacaaacagatcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagcctcactgaaccataagtgttttcatcaaaaaggagcagagtggcaggtccaaactatatacctgataactttaggattaaagggaaagatagtgtaccattgcctccctgcttttattgtcatttaaagtttcgtcttcatggagctactttacattaaatgtctgtatgattgataggaaatagatatttcagaggctcaatcgtgcctcaggcttaccacttgagtcgccatgctctccaaggatcagcccatgacagctttcagagtggatgccaagcctttgcccaataaagtaacgaaaacgagcagagtccagattacaaccacttccaataacacggtttttgggaaatccactcaacttccaggctacataagttaagatatccactaagaagaaaaagttcatatcaagaaatgtcctcatctacaaggatatgttttttagatttacctaacttaaaactagtaaatctgatgttttgtggaggaggcaagaaacatggttctctatccaaccccagctatacgccaactcttaagaatatctaccaaatagaagtaatgaaaaaccttttcgttgatactttgcacagcttggtatgcagaaacacagaatgttcactccacagaaaat

SEQ ID NO: 196585 - DNA, 441 bp, Homo sapiens
  Payload ID: 18776
  Gene Name: tumor susceptibility 101
  ENST ID: ENST00000580814
  CDS Start-End: 1-192
atcctgaatctgtatgcagaagaaaacgctattgaagacactatcttttacttgggagaagccttgagaaggggcgtgatagacctggatgtcttcctgaagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcaacttcagtgccctgaacggttagagaaattaatgaaggagctccaccaggtgccttcacaactctgagtcatatcagaatctctccacagctctcctttcaaaaatgacaccgtgacatttcaggatgtgaaaaaacttactggaaagtgtgtaagaaaatataaaatactattgtacaatgtgataa

SEQ ID NO: 196586 - DNA, 2351 bp, Homo sapiens
  Payload ID: 18777
  Gene Name: tumor-associated calcium signal transducer 2
  Uniprot ID: P09758
  ENST ID: ENST00000371225
  CDS Start-End: 618-1589
cgggtctgatagtccctacctgtcaggactggtgttaggatgagataatgtttgtgaactgtaaactatataaacgtgtgctactgtgagaactggacaaagaagagagggagtgagagaaattaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgccgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaa

SEQ ID NO: 196587 - DNA, 556 bp, Homo sapiens
  Payload ID: 18778
  Gene Name: TVP23C-CDRT4 readthrough
  ENST ID: ENST00000481756
  CDS Start-End: 25-138
aagcagggctggcgtagggccgccatgttgcagcaggatagtaatgatgacactgaagatgtttcactgtttgatgcggaagaggagacgactaatagaccaagaaaagccaaaatcagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggaatctgaacctgtgatgttaagaaatcagtaaatattaaaaagaagatggatgcaagaaggatgaagaaagaagaaggactcacagaaaacactggacttccccggaagctacttgaaaaacatgacccctggccggcctatgtcacctatacctctcagacagtgaaaagactcattgagaaaagcaaaactagagaactggaatgcatgcgt

SEQ ID NO: 196588 - DNA, 2833 bp, Homo sapiens
  Payload ID: 18778
  Gene Name: TVP23C-CDRT4 readthrough
  ENST ID: ENST00000522212
  CDS Start-End: 114-608
ctcttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggaatctgaacctgtgatgttaagaaatcagtaaatattaaaaagaagatggatgcaagaaggatgaagaaagaagaaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatt

SEQ ID NO: 196589 - DNA, 520 bp, Homo sapiens
  Payload ID: 18778
  Gene Name: TVP23C-CDRT4 readthrough
  ENST ID: ENST00000518506
  CDS Start-End: 1-162
atgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggaatctgaacctgtgatgttaagaaatcagtaaatattaaaaagaagatggatgcaagaaggatgaagaaagaagaaggactcacagaaaacactggacttccccggaagctacttgaaaaacatgacccctggccgg

SEQ ID NO: 196590 - DNA, 1005 bp, Homo sapiens
  Payload ID: 18778
  Gene Name: TVP23C-CDRT4 readthrough
  ENST ID: ENST00000557349
  CDS Start-End: 112-225
cttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaaagacggtctcgccacattgcccagactggtctgaaagtcttgggctcaagagatcctcccgcttccgccttccaaagcgctgggataacaggcgtgagccgctgcccgggccatccctcgaggaagtttcatcaggactcacagaaaacactggacttccccggaagctacttgaaaaacatgacccctggccggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgat

SEQ ID NO: 196591 - DNA, 2088 bp, Homo sapiens
  Payload ID: 18779
  Gene Name: tweety family member 1
  Uniprot ID: Q9H313
  ENST ID: ENST00000301194
  CDS Start-End: 123-1478
ctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttctttaaaaaaaaaaaaaaaaaaatcaaaaaac

SEQ ID NO: 196592 - DNA, 1885 bp, Homo sapiens
  Payload ID: 18779
  Gene Name: tweety family member 1
  Uniprot ID: Q9H313
  ENST ID: ENST00000376530
  CDS Start-End: 104-1456
gctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagca

SEQ ID NO: 196593 - DNA, 1763 bp, Homo sapiens
  Payload ID: 18779
  Gene Name: tweety family member 1
  Uniprot ID: Q9H313
  ENST ID: ENST00000376531
  CDS Start-End: 28-1410
gccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagca

SEQ ID NO: 196594 - DNA, 3678 bp, Homo sapiens
  Payload ID: 18779
  Gene Name: tweety family member 1
  ENST ID: ENST00000391739
  CDS Start-End: 1-115
cctcatccgcttctgctgctgccggccccccgagccccccgggtccaagatcccctcgcccgggggaggctgcgtcacctggagctgcattgtcgcccttctcgccggctggtaatggggccccagggtgggtgggcggtggggacagggctccccaagctctttgctggccttcctgggggtgtcctccggggacatggaggaagcagacaggaaggaggaaactccctcgtccctgtccctgccatttgcaagcccacttcagcgcacagcaggaaggactgtcccatttgatggatggagaaagtgaggctctggagaggaagtgaatcaagggcagccatctgcactggcattggcatcggtttctatggcaacagtgagaccagtgatggggtgtcccagctcagctctgcgctgctgcacgccaaccacacactcagcaccattgaccacctgacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggtgaagcccctcccctcccaatttcttctcccacggggggcctctgtctcgacccacagaactacctcctccttctccttggacccctgccattgcgcctgaggatatctctgtatcctctgtttatatgatttatctgtcctatatctattctctacctatttataacctgtcgtctacctacctatcaagcattatccatattccttccctcctccctccctttccccccaactcccgcactccccgctgggtccccatcccaccctccccgtcccttcctgccaccttttccttccttgtcttctctcctctctccgtcctcctgcctctccctccctcctagaggctgccgcttagtgagttctggagcaagactgcctgggttccagtcctacctcctgaccaagggcaagtcacctaacttctctgtacctcagttagttccctcacttataaacctgggattgcaagagtgggcacctgtccagctcccctgcggcttgtgctgttcatacactggacaggcaggggtgggcagggtgcccaggaggaaagatatctggtgtcctgcaggctccagtttgggctctgccgcaggctgcacggccataggcaggtgagcgtggctgactctgcttcccacccgtaccgtgaggaaggacgagttttttttgtttgtttttttttcactggatggctgtgaggattgaaaaaaaaaatccccttataaaacagtaggagctggccgggcgcggaggctcacacctgtaatcccagcactttgggaggcccaggcgggtggatcacctgaggtcaggagttcaagaccagtctggccaacatggtgataccccgtctctactaaaaatagaaaaagttagccgggcatggtggtgggcgcctataatcccaactactcgggaggctgaggcaggagaatcgcttgaatccacgaggcagaggttgcagtgagccaagattgtgccactgcactccagcctgggcaacaagagcgaaactctgtcacaaacaaacaaacaaaaccagtaagagctgttctaaaacacacacccgaggatgcctttccccggccagtcttcccatcaaagacctcacatgtgcatagcttcaccaagtacctgaccctgttgcatttcacaggtggtaactcatcgatgcctcataacaatgctatgaagaaggaactatgattatcccacctaacaggttagaagatgaggagcagagttgagggaccttcccaaggtcacacggccagccagcccatgcacactgaggagagagggaccttccggagggccccgccctctgccccccacagccaggcagttgcccagttttgtcctttctgcttctggaatgtcttcatccatctactctcaatgcccaatgcccctgccgcagctgaggcctcgttctctcccctgcagaaggaagcatggccccctccccatccatccccccatggaccctagaatagggctgccagattcagcaaacagcaaaccactctgctataagtacgcccggtgcaatgctggggagatacttatactagaaaattatgtattgggcatccgatactcaaatgtaactggaagtcctgaatttgatctggcaaccctacccaagagggatttgtctacgccatcgcatggatctgagctttccctggtctggctcagacagaccccttctgtggctcccactgcctcccacccttctggaactggcattccaaaaagggagtggggagtaagcactgaagccatgctcagaattgctgactattgagctgagaaaggctgggcccccacccagcccagggctgccctgatcttttgcataaggataaactggggttcaggcgcttttctgtggcctaggcagaaactgggctggaatacaggcccccagactcctttgtggagggagggaagggaaggaagaggacagatcactctacccttccctaccactgcaccatgagaccctgggtctccatctcccctgtcagtgtgccagggtcctcacagattaaaatcaagaataagcggcggggccgggcactgtggctcacgcctgtaatcccagcactttgggaaaccaaggtgggcggatcaccagaggtcaggagtttgagaccagcctggccagcatggcgaaatcccatctctactaaaaatacaaaaaaactagccgggcgtggtggcacacccctgtattcctagctactcaggaggctgaggcacgagaattgcttgaacctgggcagtggaggttgcagtgagctgagatcgagccactgcactccagccggggtgacagagcgagaatccgtctcaaaaaaaaaaaaaaaaataggagggggctagggatgggtgcctcgtgcctataaacccagcactttgggaggcccagtggggcagatcagaactccttgagctcaggagttcaagaccagcctggccaacatggtgaaaccccatctctatt

SEQ ID NO: 196595 - DNA, 505 bp, Homo sapiens
  Payload ID: 18779
  Gene Name: tweety family member 1
  ENST ID: ENST00000423529
  CDS Start-End: 35-505
ctgatttcaatcgcgatgcaagccagctgtccggatgccgccgacgccagcagcgcggtacctgcgcgggcagcagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtg

SEQ ID NO: 196596 - DNA, 929 bp, Homo sapiens
  Payload ID: 18779
  Gene Name: tweety family member 1
  ENST ID: ENST00000445095
  CDS Start-End: 89-929
gccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggatcagagcagcctcgcggttacacaacggccacctccaacaacgccgctccaccggctccggcctcggcccagactcacgcccgctctggcccggagacctcccgaagccgcacgcggggatccgcggccccagtcaccgccagaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccc

SEQ ID NO: 196597 - DNA, 665 bp, Homo sapiens
  Payload ID: 18779
  Gene Name: tweety family member 1
  ENST ID: ENST00000425969
  CDS Start-End: 44-385
cgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgt

SEQ ID NO: 196598 - DNA, 2088 bp, Homo sapiens
  Payload ID: 18779
  Gene Name: tweety family member 1
  Uniprot ID: Q9H313
  ENST ID: ENST00000616929
  CDS Start-End: 123-1478
ctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctatgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctgctcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttctttaaaaaaaaaaaaaaaaaaatcaaaaaac

SEQ ID NO: 196599 - DNA, 2088 bp, Homo sapiens; identical to SEQ ID NO: 196591
  Payload ID: 18779
  Gene Name: tweety family member 1
  Uniprot ID: Q9H313
  ENST ID: ENST00000611133
  CDS Start-End: 123-1478

SEQ ID NO: 196600 - DNA, 1850 bp, Homo sapiens
  Payload ID: 18779
  Gene Name: tweety family member 1
  Uniprot ID: Q9H313
  ENST ID: ENST00000619450
  CDS Start-End: 104-1456
gctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggtt

SEQ ID NO: 196601 - DNA, 1885 bp, Homo sapiens
  Payload ID: 18779
  Gene Name: tweety family member 1
  Uniprot ID: Q9H313
  ENST ID: ENST00000620298
  CDS Start-End: 104-1456
gctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctatgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctgctcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagca

SEQ ID NO: 196602 - DNA, 1537 bp, Homo sapiens
  Payload ID: 18779
  Gene Name: tweety family member 1
  ENST ID: ENST00000617153
  CDS Start-End: 63-380
gctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggtgggaccggcctcgcggttacacaacggccacctccaacaacgccgctccaccggctccggcctcggcccagactcacgcccgctctggcccggagacctcccgaagccgcacgcggggatccgcggccccagtcaccgccagaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctgagcccctcctcccggctggactggagcctg

SEQ ID NO: 196603 - DNA, 2088 bp, Homo sapiens; identical to SEQ ID NO: 196591
  Payload ID: 18779
  Gene Name: tweety family member 1
  Uniprot ID: Q9H313
  ENST ID: ENST00000619591
  CDS Start-End: 123-1478

SEQ ID NO: 196604 - DNA, 2692 bp, Homo sapiens
  Payload ID: 18779
  Gene Name: tweety family member 1
  ENST ID: ENST00000619108
  CDS Start-End: 42-182
cagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggatcagagcaggtgaatatgtcccagataaggtgggacccaggagacagcggacctgataacggtggcggggaaaacgctggctgctgcggtgctgggatgggattgagagtctgaaatggggaagggggcttcaggggctgaggaccagggctggaaaatgaaggggctctgggagaggaagcttcttgcccgtcccaagaaagaaggggtggtcagggcgctgcaggggtgagggccgagatgaggctgggtttggggagcctcgggatgacagacccgggtcccgagggtggggccggtgtgggaacctcacagaagccggtgtccctggggaaggggcccggctcggggcagctccaatgggcgaaagagctgtcccctgacccagtttaattcaagtccttgacttcgagattaatgaggagaaaggcttggctgagctggggacgggtgggggtgctgggagtcccgatgtggccccaggacgggtcctggccctgctgatggggcctgagcccctgggctccgtcttgggttgctcctgggagaagggggctgggattggagagctcagggggcgtggagggggtcccagaaaagcgcggaggggatgagtgctgtgttctgagctatttgggtcacggctggcacagccctgagcagctcttccccgcctgctcctcgccgccccctctccccacacacggggaccgccgtcccctcgcccacagcctcgcggttacacaacggccacctccaacaacgccgctccaccggctccggcctcggcccagactcacgcccgctctggcccggagacctcccgaagccgcacgcggggatccgcggccccagtcaccgccagaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagca

SEQ ID NO: 196605 - DNA, 1239 bp, Homo sapiens
  Payload ID: 18779
  Gene Name: tweety family member 1
  Uniprot ID: Q9H313
  ENST ID: ENST00000622771
  CDS Start-End: 92-811
gtcctgtctcatgataacactatttcacagaggacctgggctgtggcccagacacagtaaacagcaggaggctgagcttggagggtggtgaatgtggctggcctatgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctgctcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagc

SEQ ID NO: 196606 - DNA, 3869 bp, Homo sapiens
  Payload ID: 18779
  Gene Name: tweety family member 1
  Uniprot ID: Q9H313
  ENST ID: ENST00000620133
  CDS Start-End: 488-1450
aacggccacctccaacaacgccgctccaccggctccggcctcggcccagactcacgcccgctctggcccggagacctcccgaagccgcacgcggggatccgcggccccagtcaccgccagaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctggtaatggggccccagggtgggtgggcggtggggacagggctccccaagctctttgctggccttcctgggggtgtcctccggggacatggaggaagcagacaggaaggaggaaactccctcgtccctgtccctgccatttgcaagcccacttcagcgcacagcaggaaggactgtcccatttgatggatggagaaagtgaggctctggagaggaagtgaatcaagggcagccatctgcactggcattggcatcggtttctatggcaacagtgagaccagtgatggggtgtcccagctcagctctgcgctgctgcacgccaaccacacactcagcaccattgaccacctgacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggtgaagcccctcccctcccaatttcttctcccacggggggcctctgtctcgacccacagaactacctcctccttctccttggacccctgccattgcgcctgaggatatctctgtatcctctgtttatatgatttatctgtcctatatctattctctacctatttataacctgtcgtctacctacctatcaagcattatccatattccttccctcctccctccctttccccccaactcccgcactccccgctgggtccccatcccaccctccccgtcccttcctgccaccttttccttccttgtcttctctcctctctccgtcctcctgcctctccctccctcctagaggctgccgcttagtgagttctggagcaagactgcctgggttccagtcctacctcctgaccaagggcaagtcacctaacttctctgtacctcagttagttccctcacttataaacctgggattgcaagagtgggcacctgtccagctcccctgcggcttgtgctgttcatacactggacaggcaggggtgggcagggtgcccaggaggaaagatatctggtgtcctgcaggctccagtttgggctctgccgcaggctgcacggccataggcaggtgagcgtggctgactctgcttcccacccgtaccgtgaggaaggacgagttttttttgtttgtttttttttcactggatggctgtgaggattgaaaaaaaaaatccccttataaaacagtaggagctggccgggcgcggaggctcacacctgtaatcccagcactttgggaggcccaggcgggtggatcacctgaggtcaggagttcaagaccagtctggccaacatggtgataccccgtctctactaaaaatagaaaaagttagccgggcatggtggtgggcgcctataatcccaactactcgggaggctgaggcaggagaatcgcttgaatccacgaggcagaggttgcagtgagccaagattgtgccactgcactccagcctgggcaacaagagcgaaactctgtcacaaacaaacaaacaaaaccagtaagagctgttctaaaacacacacccgaggatgcctttccccggccagtcttcccatcaaagacctcacatgtgcatagcttcaccaagtacctgaccctgttgcatttcacaggtggtaactcatcgatgcctcataacaatgctatgaagaaggaactatgattatcccacctaacaggttagaagatgaggagcagagttgagggaccttcccaaggtcacacggccagccagcccgtgcacactgaggagagagggaccttccggagggccccgccctctgccccccacagccaggcagttgcccagttttgtcctttctgcttctggaatgtcttcatccatctactctcaatgcccaatgcccctgccgcagctgaggcctcgttctctcccctgcagaaggaagcatggccccctccccatccatccccccatggaccctagaatagggctgccagattcagcaaacagcaaaccactctgctataagtacgcccggtgcaatgctggggagatacttatactagaaaattatgtattgggcatccgatactcaaatgtaactggaagtcctgaatttgatctggcaaccctacccaagagggatttgtctacgccatcgcatggatctgagctttccctggtctggctcagacagaccccttctgtggctcccactgcctcccacccttctggaactggcattccaaaaagggagtggggagtaagcactgaagccatgctcagaattgctgactattgagctgagaaaggctgggcccccacccagcccagggctgccctgatcttttgcataaggataaactggggttcaggcgcttttctgtggcctaggcagaaactgggctggaatacaggcccccagactcctttgtggagggagggaagggaaggaagaggacagatcactctacccttccctaccactgcaccatgagaccctgggtctccatctcccctgtcagtgtgccagggtcctcacagattaaaatcaagaataagcggcggggccgggcactgtggctcatgcctgtaatcccagcactttgggaaaccaaggtgggcggatcaccagaggtcaggagtttgagaccagcctggccagcatggcgaaatcccatctctactaaaaatacaaaaaaactagccgggcgtggtggcacacccctgtattcctagctactcaggaggctgaggcacgagaattgcttgaacctgggcagtggaggttgcagtgagctgagatcgagccactgcactccagccggggtgacagagcgagaatccgtctcaaaaaaaaaaaaaaaaaataggagggggctagggatgggtgcctcgtgcctataaacccagcactttgggaggcccagtggggcagatcagaactccttgagctcaggagttcaagaccagcctggccaacatggtgaaaccccatctctatt

SEQ ID NO: 196607 - DNA, 3878 bp, Homo sapiens
  Payload ID: 18779
  Gene Name: tweety family member 1
  ENST ID: ENST00000618512
  CDS Start-End: 488-1459
aacggccacctccaacaacgccgctccaccggctccggcctcggcccagactcacgcccgctctggcccggagacctcccgaagccgcacgcggggatccgcggccccagtcaccgccagaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctggtaatggggccccagggtgggtgggcggtggggacagggctccccaagctctttgctggccttcctgggggtgtcctccggggacatggaggaagcagacaggaaggaggaaactccctcgtccctgtccctgccatttgcaagcccacttcagcgcacagcaggaaggactgtcccatttgatggatggagaaagtgaggctctggagaggaagtgaatcaagggcagccatctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctatgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggtgaagcccctcccctcccaatttcttctcccacggggggcctctgtctggacccacagaactacctcctccttctccttggacccctgccattgcgcctgaggatatctctgtatcctctgtttatatgatttatctgtcctatatctattctctacctatttataacctgtcgtctacctacctatcaagcattatccatattccttccctcctccctccctttccccccaactcccgcactccccgctgggtccccatcccaccctccccgtccattcctgccaccttttccttccttgtcttctctcctctctccgtcctcctgcctctccctccctcctagaggctgccgcttagtgagttctggagcaagactgcctgggttccagtcctacctcctgaccaagggcaagtcacctaacttctctgtacctcagttagttccctcacttataaacctgggattgcaagagtgggcacctgtccagctcccctgcggcttgtgctgttcatacactggacaggcaggggtgggcagggtgcccaggaggaaagatatctggtgtcctgcaggctccagtttgggctctgccgcaggctgcacggccataggcaggtgagcgtggctgactctgcttcccacccgtaccgtgaggaaggacgagttttttttgtttgtttttttttcactggatggctgtgaggattgaaaaaaaaaatccccttataaaacagtaggagctggccgggcgcggaggctcacacctgtaatcccagcactttgggaggcccaggcgggtggatcacctgaggtcaggagttcaagaccagtctggccaacatggtgataccccgtctctactaaaaatagaaaaagttagccgggcatggtggtgggcgcctataatcccaactactcgggaggctgaggcaggagaatcgcttgaatccacgaggcagaggttgcagtgagccaagattgtgccactgcactccagcctgggcaacaagagcgaaactctgtcacaaacaaacaaacaaaaccagtaagagctgttctaaaacacacacccgaggatgcctttccccggccagtcttcccatcaaagacctcacatgtgcatagcttcaccaagtacctgaccctgttgcatttcacaggtggtaactcatcgatgcctcataacaatgctatgaagaaggaactatgattatcccacctaacaggttagaagatgaggagcagagttgagggaccttcccaaggtcacacggccagccagcccgtgcacactgaggagagagggaccttccggagggccccgccctctgccccccacagccaggcagttgcccagttttgtcctttctgcttctggaatgtcttcatccatctactctcaatgcgcaatgcccctgctgcagctgaggcctcgttctctcccctgcagaaggaagcatggccccctccccatccgtccccccatggaccctagaatagggctgccagattcagcaaacagcaaaccactctgctataagtacgcccggtgcaatgctggggagatacttatactagaaaattatgtattgggcatccgatactcaaatgtaactggaagtcctgaatttgatctggcaaccctacccaagagggatttgtctacgccatcgcgtggatctgagctttccctggtctggctcagacagaccccttctgtggctcccactgcctcccacccttctggaactggcattccaaaaagggagtggggagtaagcactgaagccatgctcagaattgctgactattgagctgagaaaggctgggcccccacccagcccagggctgccctgatcttttgcataaggataaactggggttcaggcgcttttctgtggcctaggcagaaactgggctggaatacaggcccccagactcctttgtggagggagggaagggaaggaagaggacagatcactctacccttccctaccactgcaccatgagaccctgggtctccatctcccctgtcagtgtgccagggtcctcacagattaaaatcaagaataagcggcggggccgggcactgtggctcacgcctgtaatcccagcactttgggaaaccaaggtgggcggatcaccagaggtcaggagtttgagaccagcctggccagcatggcgaaatcccatctctactaaaaatacaaaaaaactagccgggcgtggtggcgcacccctgtattcctagctactcaggaggctgaggcacgagaattgcttgaacctgggcagtggaggttgcagtgagctgagatcgagccactgcactccagccggggtgacagagcgagaatccgtctcaaaaaaaaaaaaaaaaaataggagggggctagggatgggtgcctcgtgcctatcaacccagcactttgggaggcccagtggggcagatcagaactccttgagctcaggagttcaagaccagcctggccaacatggtgaaaccccatctctatt

SEQ ID NO: 196608 - DNA, 1239 bp, Homo sapiens
  Payload ID: 18779
  Gene Name: tweety family member 1
  Uniprot ID: Q9H313
  ENST ID: ENST00000614387
  CDS Start-End: 92-811
gtcctgtctcatgataacactatttcacagaggacctgggctgtggcccagacacagtaaacagcaggaggctgagcttggagggtggtgaatgtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcagcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagc

SEQ ID NO: 196609 - DNA, 1760 bp, Homo sapiens
  Payload ID: 18779
  Gene Name: tweety family member 1
  Uniprot ID: Q9H313
  ENST ID: ENST00000619453
  CDS Start-End: 28-1410
gccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctatgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctgctcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 196610 - DNA, 2090 bp, Homo sapiens
  Payload ID: 18779
  Gene Name: tweety family member 1
  Uniprot ID: Q9H313
  ENST ID: ENST00000611711
  CDS Start-End: 128-1480
accccctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttctttaaaaaaaaaaaaaaaaaaatcaaaaaac

SEQ ID NO: 196611 - DNA, 1760 bp, Homo sapiens
  Payload ID: 18779
  Gene Name: tweety family member 1
  Uniprot ID: Q9H313
  ENST ID: ENST00000614458
  CDS Start-End: 28-1410
gccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 196612 - DNA, 1760 bp, Homo sapiens; identical to SEQ ID NO: 196611
  Payload ID: 18779
  Gene Name: tweety family member 1
  Uniprot ID: Q9H313
  ENST ID: ENST00000611471
  CDS Start-End: 28-1410

SEQ ID NO: 196613 - DNA, 3490 bp, Homo sapiens
  Payload ID: 18780
  Gene Name: tweety family member 2
  Uniprot ID: Q9BSA4
  ENST ID: ENST00000269346
  CDS Start-End: 75-1679
gggcgggcacggggccccggccgggaggtgagcgcagctgtcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggctctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtactaaaa

SEQ ID NO: 196614 - DNA, 3661 bp, Homo sapiens
  Payload ID: 18780
  Gene Name: tweety family member 2
  Uniprot ID: Q9BSA4
  ENST ID: ENST00000441391
  CDS Start-End: 1213-1854
accgtaagtgctgtgatgcactaacctctaggtgctagaaccctgcacggcactgagtaagtactccataaatgtctatcaacttagcaagttagtgagtgatgctctattgtggacccctgaggcagtggctcctgaaggaggacggggccaccggcagagcagggcactcagaggggtcccctgcccggggagcatgtgccagaggagggggacatccctaaggaacaggccagaggacctgagctctccctggctgctctggaaggcggaggccccccagtttatccagtccctagagcaccccaggccagatctggggtgcgcctggcttggaggccatgtccttgctgccgcctctcctggggcctgcgtctgctcccaccctgccgcatgggccttagcaatcacttagccaggccgtgctgtggggccaggtcctccagctcataagtggcagccgcctctcagctccatgcccttcccaccccatgtcttggcaggtgagcacctgcacccaaggctcacagatgcttcagcaccaacctcattctttagaaagagtttgggggaggcttcatagattgaacacccgtccctgtagcacttgatcatagcaagacaaaatgtaaaacagcagatgaggccatggtgtaacgaactcccacacacacagcctgcagctgccctggggcccaggatgctggcccccaaaggtctgtcccagaagaggcattcgggaataagagtaacagcatgcgctctgccccagtcacttttctgagcactttacttgcattgggtgaatagcattatcatctccatgtcacagatgaggcaaccggggcacaggaagaataagtaacttgtccaaggcaacagagctaggaaggggcagagccaggtttgaacccaggaggctggctccagactgtcctttgccacctgggagggagctcaaggggctggggtgatgggctcccggctcctcccagggccccgctgtcctgatacctgattttcctccaccccgtccctctctccctcactcaggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtact

SEQ ID NO: 196615 - DNA, 2015 bp, Homo sapiens
  Payload ID: 18780
  Gene Name: tweety family member 2
  ENST ID: ENST00000529107
  CDS Start-End: 32-1573
cctcaccaccactcagatcgctgagtaggagatgagcgtggtgggccaggaccggaagtctggctctgggtgttatttaaggtggctcctgtttttgtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggctctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgtt

SEQ ID NO: 196616 - DNA, 532 bp, Homo sapiens
  Payload ID: 18780
  Gene Name: tweety family member 2
  ENST ID: ENST00000528128
  CDS Start-End: 1-415
gtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggctctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcacttaccaccatgcagatccaggtcgcggggctgctgcagtttgccgtgcccctcttctccactgcagagacctgcttgcaatccagctcctgctgaactcctcagagtccagccttcaccagctgaccgccatggtggactgccgagggctgcacaaggattatctggacgctcttgctggcatctgctacgacggcctccagggcttgctgt

SEQ ID NO: 196617 - DNA, 797 bp, Homo sapiens
  Payload ID: 18780
  Gene Name: tweety family member 2
  ENST ID: ENST00000526858
  CDS Start-End: 1-414
gcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggccaagcctgtcccctttgccccctcttctcaaggtgtgctgcttcttgccatcctggcctcagcttcagtgcccccgtctctggttccccaccctgcaacctcctccgccctgttcagagccagcttcttagtgcccagctcacagattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcc

SEQ ID NO: 196618 - DNA, 4840 bp, Homo sapiens
  Payload ID: 18781
  Gene Name: tweety family member 3
  Uniprot ID: Q9C0H2
  ENST ID: ENST00000258796
  CDS Start-End: 206-1777
cggcgaacaaagaggcggcgggcgcgggcggccgagcggagccgagcgcagccgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 196619 - DNA, 560 bp, Homo sapiens
  Payload ID: 18781
  Gene Name: tweety family member 3
  ENST ID: ENST00000400376
  CDS Start-End: 212-560
cttttgtgttcagagacctggggagagccacactggaaggccgtgcttggagccagacagggctgtgtgtccgatggggcgcctgtatgcagcctgtagcagtgtggggccagccccaccatctcatccagcgtgggggcacgccatggacggtgcccacccctgagtgcagcttctcggtgcacagaccccagacaggatcagactcctgatggggcctcttccatgttcacccctcagaaacactttcatggtcagcaagagggggttcagtcccccacaggctcccaatttccctaccagacctgaaaacctcaggactacagctggggtgggggatcctgccaggactcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacgggg

SEQ ID NO: 196620 - DNA, 4263 bp, Homo sapiens
  Payload ID: 18781
  Gene Name: tweety family member 3
  Uniprot ID: Q9C0H2
  ENST ID: ENST00000403167
  CDS Start-End: 144-1202
tttgctctcagcacctagtacatgaggcctgatgggcagggtgtggcccagggccactggaggtcacaggcagtggctggagttcccctaatgggagcctttctcaagaactgacaccagtccccatgacccagacgctctgaatgccctctggggtgccaggctgctggcctcagctccccctcaagggcccctggcgccccactcccaggccccgggtccctgtgccctggcgcactcccaggtttgcctgcaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagc

SEQ ID NO: 196621 - DNA, 4537 bp, Homo sapiens
  Payload ID: 18781
  Gene Name: tweety family member 3
  Uniprot ID: Q9C0H2
  ENST ID: ENST00000407643
  CDS Start-End: 1-1476
atggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacagggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagc

SEQ ID NO: 196622 - DNA, 756 bp, Homo sapiens
  Payload ID: 18781
  Gene Name: tweety family member 3
  ENST ID: ENST00000429448
  CDS Start-End: 1-561
gaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcacgctatctggctgccctggactctggcagccacgcgggctggcagtttaagcccatggacagtgcccgaacgctgtggtagctgttccctcagagcgacagtacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgcca

SEQ ID NO: 196623 - DNA, 3045 bp, Homo sapiens
  Payload ID: 18782
  Gene Name: twinfilin actin binding protein 1
  Uniprot ID: Q12792
  ENST ID: ENST00000395510
  CDS Start-End: 131-1183
gggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaa

SEQ ID NO: 196624 - DNA, 3320 bp, Homo sapiens
  Payload ID: 18782
  Gene Name: twinfilin actin binding protein 1
  ENST ID: ENST00000547459
  CDS Start-End: 18-377
agctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttt

SEQ ID NO: 196625 - DNA, 396 bp, Homo sapiens
  Payload ID: 18782
  Gene Name: twinfilin actin binding protein 1
  ENST ID: ENST00000548403
  CDS Start-End: 56-396
ggccggggccgctggctgcactcagcgccggagccgggagctagcggccgccgccatgtcccaccagaccggcatccaagagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtc

SEQ ID NO: 196626 - DNA, 925 bp, Homo sapiens
  Payload ID: 18782
  Gene Name: twinfilin actin binding protein 1
  ENST ID: ENST00000546662
  CDS Start-End: 52-925
ggggccgctggctgcactcagcgccggagccgggagctagcggccgccgccatgtcccaccagaccggcatccaagatactccccaagggaaactgatctgtatggttgcatgtaatgcgtgcagacagttcaatatgcagttatatctgacctccattatttcctggtttgaaattgggcagcctgcagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatag

SEQ ID NO: 196627 - DNA, 582 bp, Homo sapiens
  Payload ID: 18782
  Gene Name: twinfilin actin binding protein 1
  ENST ID: ENST00000546506
  CDS Start-End: 538-582
acttcctggggccgccggccggggccgctggctgcactcagcgccggagccgggagctagcggccgccgccatgtcccaccagaccggcatccaagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttgga

SEQ ID NO: 196628 - DNA, 612 bp, Homo sapiens
  Payload ID: 18782
  Gene Name: twinfilin actin binding protein 1
  ENST ID: ENST00000550371
  CDS Start-End: 84-263
ggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgtttctgcaccacagtccatttctaatgtcagtgcttccatctctggaatggaaatcactaaacagagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacg

SEQ ID NO: 196629 - DNA, 3012 bp, Homo sapiens
  Payload ID: 18782
  Gene Name: twinfilin actin binding protein 1
  Uniprot ID: Q12792
  ENST ID: ENST00000552521
  CDS Start-End: 392-1150
ggctgcactcagcgccggagccgggagctagcggccgccgccatgtcccaccagaccggcatccaagggaagagctgggacagtggaggcgactggggcttcagtacgctgtcgagaaccagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaa

SEQ ID NO: 196630 - DNA, 1170 bp, Homo sapiens
  Payload ID: 18782
  Gene Name: twinfilin actin binding protein 1
  Uniprot ID: Q12792
  ENST ID: ENST00000548315
  CDS Start-End: 5-1078
cgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgagagcccagaggatcatattggggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtag

SEQ ID NO: 196631 - DNA, 1718 bp, Homo sapiens
  Payload ID: 18783
  Gene Name: twinfilin actin binding protein 2
  Uniprot ID: Q6IBS0
  ENST ID: ENST00000305533
  CDS Start-End: 245-1294
atccttagacccacccggaccgaggcgcaggctgcgcgcacgcgcggccccgagtccccgcctccctgccgcgcctgtcgggggcggggcgccgctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaaga

SEQ ID NO: 196632 - DNA, 1440 bp, Homo sapiens
  Payload ID: 18783
  Gene Name: twinfilin actin binding protein 2
  ENST ID: ENST00000499914
  CDS Start-End: 127-891
cccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatg

SEQ ID NO: 196633 - DNA, 1666 bp, Homo sapiens
  Payload ID: 18784
  Gene Name: twist family bHLH transcription factor 1
  Uniprot ID: Q15672
  ENST ID: ENST00000242261
  CDS Start-End: 352-960
gaggtataagagcctccaagtctgcagctctcgcccaactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaa

SEQ ID NO: 196634 - DNA, 589 bp, Homo sapiens
  Payload ID: 18784
  Gene Name: twist family bHLH transcription factor 1
  ENST ID: ENST00000354571
  CDS Start-End: 1-406
cccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatttcttaaggtacaccaggatggagctggccatgactgctgagaagaagcacatgtccagatgataattcacgcacagttacaggttcccctccccaaagtggaacgtattattaataaaataatgttaaggagcagaaa

SEQ ID NO: 196635 - DNA, 527 bp, Homo sapiens
  Payload ID: 18784
  Gene Name: twist family bHLH transcription factor 1
  ENST ID: ENST00000443687
  CDS Start-End: 1-212
agatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatttcttaaggtacaccaggatggagctggccatgactgctgagaaggtgtgatacaattcagaaaataatttgtaattaagaaaaatcagacaagatggagaacaagaacaaatgtggagatgacttccagaggcaagaaaaaacacttcacagaagaatgaggttttattcccaaaagaaagaatgcttccatcagaagacataataatgattccattgaactggaaattaagatggttacctgaccaatttgggattcttatgcttctga

SEQ ID NO: 196636 - DNA, 1176 bp, Homo sapiens
  Payload ID: 18785
  Gene Name: twist family bHLH transcription factor 2
  Uniprot ID: Q8WVJ9
  ENST ID: ENST00000448943
  CDS Start-End: 185-667
ctagagtttccaaaaaagttagaataacttcctctcccggagacctcggttttgcacaagccggccttgaaatcagagcctttccagcaactccgagagcgtgtgctcggcgaccgcgggcttggccagcggcgcgcgctcggcgccccggcgcccccagccccacgcgcgccgggcgggcgccatggaggagggctccagctcgcccgtgtcccccgtggacagcctgggcaccagcgaggaggagctcgagaggcagcccaagcgcttcggccggaagcggcgctacagcaagaagtcgagcgaagatggcagcccgaccccgggcaagcgcggcaagaagggcagccccagcgcgcagtccttcgaggagctgcagagccagcgcatcctggccaacgtgcgcgagcgccagcgcacccagtcgctcaacgaggccttcgcggcgctgcgcaagatcatccccacgctgccctctgacaagctgagcaagatccagacgctcaagctggccgccaggtacatagacttcctctaccaggtcctgcagagcgacgagatggacaataagatgaccagctgcagctacgtggcccacgagcgcctcagctacgccttctccgtgtggcgcatggagggcgcgtggtccatgtccgcctcccactagcgccgcgccacccacctccggaccggcgcgccaggaggagattctgaatgatgctgccattgccagaccttctgctaccaaacagagcgaagaggaagagggggcagtgtttggtcaagacagcccacgaaacgttggcgggagtgagcacattagcaatggctaagaacatgcttgaatcatttgtaacaacccaggacagagatgccacaagaggactttggggaaaggcgaatccactcatacatcttggagttgttttttcaagttcagaaaatgaaccttcaccaaggtcttggaacatgaagcagagactctggtgctgactctatcatttgagctcctaagggtactcatgcccagtggagcatgcacaccagcaacactgccaacaccatctcggtgtcccaccccttagaggaggaagaggacacagaggggcgcccggtaataaccctcatttcctctcttccaccccaccacatcatcttaataaaacatgaaggtaa

SEQ ID NO: 196637 - DNA, 1404 bp, Homo sapiens
  Payload ID: 18785
  Gene Name: twist family bHLH transcription factor 2
  Uniprot ID: Q8WVJ9
  ENST ID: ENST00000612363
  CDS Start-End: 185-667
ctagagtttccaaaaaagttagaataacttcctctcccggagacctcggttttgcacaagccggccttgaaatcagagcctttccagcaactccgagagcgtgtgctcggcgaccgcgggcttggccagcggcgcgcgctcggcgccccggcgcccccagccccacgcgcgccgggcgggcgccatggaggagggctccagctcgcccgtgtcccccgtggacagcctgggcaccagcgaggaggagctcgagaggcagcccaagcgcttcggccggaagcggcgctacagcaagaagtcgagcgaagatggcagcccgaccccgggcaagcgcggcaagaagggcagccccagcgcgcagtccttcgaggagctgcagagccagcgcatcctggccaacgtgcgcgagcgccagcgcacccagtcgctcaacgaggccttcgcggcgctgcgcaagatcatccccacgctgccctctgacaagctgagcaagatccagacgctcaagctggccgccaggtacatagacttcctctaccaggtcctgcagagcgacgagatggacaataagatgaccagctgcagctacgtggcccacgagcgcctcagctacgccttctccgtgtggcgcatggagggcgcgtggtccatgtccgcctcccactagcgccgcgccacccacctccggaccggcgcgccagggctgtccgtcgcgtcggcggcgcaagtggaattgggatgcattcgagtctgtaacttctgaaacctgaacaacctcaggaggcccccacctctgccctccaccagcgtcgagagaagggacagcagtgacatcggacagaagacccgggctcccgtcctcccccaggacggtccccacataggaagggcactcccagccctcttgctggtgacattgtcatggtcatcttgtttctgtttggatttttcttctgggtcttatgtttggggggaggtttattctttctgaaaatgtctagattcaggaacacatttatgaggatttggattttgaatttgtatttccctctaagtgccttttttaatgtctatttttttaataaaacagaaatgcattcttgtacaattctgttgaaactggaccaaggctctcagaagaggacccccgagttccttcccctcccccgagcctctgcatgattgtttcaagtcagcctggaattcttactttcacgccgctattcttttcctttctccgtgattgcttggctagccatttaaaaaaaaatattctctgttcagtgtatatgttgcttgtttgttttatttattgagatatttttacaagctaagtgactgcagtgtggctgtgtatcctgctccccacccaggaaaaataaagacgtccgcgcagccatggtc

SEQ ID NO: 196638 - DNA, 3942 bp, Homo sapiens
  Payload ID: 18786
  Gene Name: TWIST neighbor
  Uniprot ID: Q3B726
  ENST ID: ENST00000222567
  CDS Start-End: 72-1088
aaaacgagcgccggggacatgggattgtgcttgcgtcaacggcgcgcgccgtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagttgtgttttatgaattaaacagggaacggcatgctgaacttgaaactagatttgttcctgcttttttcacaatgtgagtagttttgaaaagtcagatctggccatttgtctttcctagaatagcataactttgttcattgttttttttgtttgtctttctgacacagaaagactgatgatggtgtccactatgtattcttcaaaacatttggcacatgctgcactaacctagtctatcttttctatcttggaatttgctcatacaaaccctatagcctagactagatcccttaccctctctccagttcctatcattcacccatttcactgtgcaagacacctcactagtcaccagtgatacagaaatgacttttaagcagtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggt

SEQ ID NO: 196639 - DNA, 3756 bp, Homo sapiens
  Payload ID: 18787
  Gene Name: twisted gastrulation BMP signaling modulator 1
  Uniprot ID: Q9GZX9
  ENST ID: ENST00000262120
  CDS Start-End: 192-863
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgacgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattattatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgtttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattccagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaattgaaatga

SEQ ID NO: 196640 - DNA, 2311 bp, Homo sapiens
  Payload ID: 18787
  Gene Name: twisted gastrulation BMP signaling modulator 1
  Uniprot ID: Q9GZX9
  ENST ID: ENST00000583147
  CDS Start-End: 192-419
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttgattgaccctcctttcatttctgtcatgccacttgacaatgaaggaactgtatcagttgacctatagaatagcccacattccggatttgactgcttcctgtggaagtcctaccatactgactgttctgtcataaacaattttcataggattatgttaaggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgacgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattattatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagt

SEQ ID NO: 196641 - DNA, 1119 bp, Homo sapiens
  Payload ID: 18787
  Gene Name: twisted gastrulation BMP signaling modulator 1
  ENST ID: ENST00000581641
  CDS Start-End: 109-663
cagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaaggtaactgccaacagttgactttttccattccgccccctcatgtggtctgtccatgtaatctataaaacctatataagaccatcttttggagcagccttttggttttgaatttgtatcatctcacataaattctagactcaataaccctgatcccatcatatctagaggcacatgccagaaggataagagaaaaaaaatatctccaatccttgagtagataaaaaggcatgtcggctgggcgtggtggctcatgcctgtaatcccagcactttgggaggccgaggcaggtggatcacgaggtcaagagttcgagaccagcctgaccaacatggtgaaaccccatctctactaagaatacaaaaattagccgggtgtggtggcgggcgcctgtagtccagctacgagggaggctgaggcaggagaattgcttgaacctgagagtcggaggttgctgtgaaccgagatcacaccactgcactccagcctgggtggcagagcaagactccgtctcaccaaaaaaa

SEQ ID NO: 196642 - DNA, 5274 bp, Homo sapiens
  Payload ID: 18788
  Gene Name: two pore segment channel 1
  Uniprot ID: Q9ULQ1
  ENST ID: ENST00000335509
  CDS Start-End: 315-2765
gagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 196643 - DNA, 2558 bp, Homo sapiens
  Payload ID: 18788
  Gene Name: two pore segment channel 1
  ENST ID: ENST00000392569
  CDS Start-End: 194-2440
ccctttcctcctttggcttaagcctttggcaggacagattttgggctggaggccagcaattcaactgggagggctctgtgccagttcttgcctttctgaagatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacagg

SEQ ID NO: 196644 - DNA, 5173 bp, Homo sapiens
  Payload ID: 18788
  Gene Name: two pore segment channel 1
  Uniprot ID: Q9ULQ1
  ENST ID: ENST00000541517
  CDS Start-End: 1-2667
atggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgt

SEQ ID NO: 196645 - DNA, 828 bp, Homo sapiens
  Payload ID: 18788
  Gene Name: two pore segment channel 1
  ENST ID: ENST00000552542
  CDS Start-End: 469-828
acatttgcccagggctctgcttgggtttggagcctttactaacgtgtgtcaataatgcgggtccaccttccataccatcttgcaaccaattatcagaaagagaaggcctgagcagggggatgtgcattttgctttctttcggcgtagcatctcatgctagatttttatctgggggcctttgaagagccagccggcacagaagcatggtggcaacgctgtgcctggaaaactcatcagtgtcactctggtttattttcctctcctctttgagctctttcccatggtgtggggctctcagtgacaactggcaagcggcggggcggttgctcgttgtcattctggtaggcgctggtttccggagggctccgagtgctttatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatc

SEQ ID NO: 196646 - DNA, 527 bp, Homo sapiens
  Payload ID: 18788
  Gene Name: two pore segment channel 1
  ENST ID: ENST00000550873
  CDS Start-End: 273-527
aacgagtaaggcggggaacaagggaggagtaaggggcgtggattcttcgtcccgccccttcttaaggaggcgggcagggagtaccgcatcggcggcgggcgagacctgcggaaggacgtgatagttggccaatcagagttcatcacgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgac

SEQ ID NO: 196647 - DNA, 570 bp, Homo sapiens
  Payload ID: 18788
  Gene Name: two pore segment channel 1
  ENST ID: ENST00000551099
  CDS Start-End: 272-570
gagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaagacgctgctgcatgctgtgctccagcaaacagaaaccttggattccctgcagggtcatttccgatgtggcgtgcaaagcagccagctgtttcgagggagcgtctgggccctgtgacatcagcatgtgggagtgttaccgtgtgtgcaaacagatggcggcagctatgccatccacgactcccaggcc

SEQ ID NO: 196648 - DNA, 530 bp, Homo sapiens
  Payload ID: 18788
  Gene Name: two pore segment channel 1
  ENST ID: ENST00000551096
  CDS Start-End: 158-530
agcggggttgagaggacggtaggcggtggataggagagctggcgcagctgccctggtggcagtggctgaagtggcggcggcttcggcggctgcggcggctgcaacagcttcgggctcggggttttggcggcggcgccggcgggctaggctgcgcgagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctca

SEQ ID NO: 196649 - DNA, 762 bp, Homo sapiens
  Payload ID: 18788
  Gene Name: two pore segment channel 1
  ENST ID: ENST00000552985
  CDS Start-End: 118-762
cgagactcggtgtctgactgacctttcttttcaccattcaatttattgttccgctcagttgtccccacctcctgaagtctgaccaatcagaagcaccgccattttgacctttcaccaatggaaagacttgggactccctctgggttggactcaacgaagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgcc

SEQ ID NO: 196650 - DNA, 526 bp, Homo sapiens
  Payload ID: 18788
  Gene Name: two pore segment channel 1
  ENST ID: ENST00000552642
  CDS Start-End: 148-526
gttgctaggttacccgccaatctcagaaggcgagactcggtgtctgactgacctttcttttcaccattcaatttattgttccgctcagttgtccccacctcctgaagtctgaccaatcagaagcaccgccattttgacctttcaccaatggaaagacttgggactccctctgggttggactcaacgaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtgg

SEQ ID NO: 196651 - DNA, 609 bp, Homo sapiens
  Payload ID: 18788
  Gene Name: two pore segment channel 1
  ENST ID: ENST00000547955
  CDS Start-End: 1-313
aggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccaggtaaggggtcacctgtgagtctaccttcacagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctct

SEQ ID NO: 196652 - DNA, 5345 bp, Homo sapiens
  Payload ID: 18788
  Gene Name: two pore segment channel 1
  Uniprot ID: Q9ULQ1
  ENST ID: ENST00000550785
  CDS Start-End: 170-2836
aggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 196653 - DNA, 593 bp, Homo sapiens
  Payload ID: 18788
  Gene Name: two pore segment channel 1
  ENST ID: ENST00000548465
  CDS Start-End: 159-593
gccaaacggtgtctttttgctcttaagcctgggtgccaagtgaatctctctcctcttccaatgcagatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcgg

SEQ ID NO: 196654 - DNA, 544 bp, Homo sapiens
  Payload ID: 18788
  Gene Name: two pore segment channel 1
  ENST ID: ENST00000549279
  CDS Start-End: 246-544
gagctggcgcagctgccctggtggcagtggctgaagtggcggcggcttcggcggctgcggcggctgcaacagcttcgggctcggggttttggcggcggcgccggcgggctaggctgcgcgaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaagacgctgctgcatgctgtgctccagcaaacagaaaccttggattccctgcagggtcatttccgatgtggcgtgcaaagcagccagctgtttcgagggagcgtctgggccctgtgacatcagcatgtgggagtgttaccgtgtgtgcaaacagatggcggcagctatgccatccacgactcccaggcc

SEQ ID NO: 196655 - DNA, 564 bp, Homo sapiens
  Payload ID: 18788
  Gene Name: two pore segment channel 1
  ENST ID: ENST00000547275
  CDS Start-End: 124-564
agaaggcgagactcggtgtctgactgacctttcttttcaccattcaatttattgttccgctcagttgtccccacctcctgaagtctgaccaatcagaagcaccgccattttgacctttcaccaatggaaagacttgggactccctctgggttggactcaacgaaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaag

SEQ ID NO: 196656 - DNA, 610 bp, Homo sapiens
  Payload ID: 18788
  Gene Name: two pore segment channel 1
  ENST ID: ENST00000546781
  CDS Start-End: 1-610
gcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaagtctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatc

SEQ ID NO: 196657 - DNA, 596 bp, Homo sapiens
  Payload ID: 18788
  Gene Name: two pore segment channel 1
  ENST ID: ENST00000552897
  CDS Start-End: 274-596
ggtaggcggtggataggagagctggcgcagctgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaa

SEQ ID NO: 196658 - DNA, 2931 bp, Homo sapiens
  Payload ID: 18789
  Gene Name: two pore segment channel 2
  Uniprot ID: Q8NHX9
  ENST ID: ENST00000294309
  CDS Start-End: 102-2360
agcaaaaacgccagggacggggtctccgcgcctgcgcagtgaagctgggcgccttcggggcttgagcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgctccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctatggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctggttttggagatctcaactctggctgtgtaccgattgccacacccaggctggaggccggagatggtgggcctgctgtcgctgtgggacatgacccgcatgctgaacatgctcatcgtgttccgcttcctgcgtatcatccccagcatgaagctgatggccgtggtggccagtaccgtcctgggcctggtgcagaacatgcgtgcgtttggcgggatcctggtggtggtctactacgtatttgccatcattgggatcaacttgtttagaggcgtcattgtggctcttcctggaaacagcagcctggcccctgccaatggctcggcgccctgtgggagcttcgagcagctggagtactgggccaacaacttcgatgactttgcggctgccctggtcactctgtggaacttgatggtggtgaacaactggcaggtgtttctggatgcatatcggcgctactcaggcccgtggtccaagatctattttgtattgtggtggctggtgtcgtctgtcatctgggtcaacctgtttctggccctgattctggagaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaattccctcgtcgactccacagggacctttcagacaaaaatgcaagaagcagcggcctcccctgtcccctgcagcttccgtggtgcctttgctgccggcagcccttggggaccacaggcctgaccagggcctgcacaggttaaccgtcagacttccggggcattcaggtggggatgctggtggtttgacatggagagaaccttgactgtgttttattatttcatggcttgtatgagtgtgactgggtgtgtttctttagggttctgattgccagttattttcatcaataagtcttgcaaagaatgggattgtcattcttcacttc

SEQ ID NO: 196659 - DNA, 2000 bp, Homo sapiens
  Payload ID: 18789
  Gene Name: two pore segment channel 2
  ENST ID: ENST00000542467
  CDS Start-End: 38-1750
agcttctgagggtcgggtccagcgcgtgggctgctggatggcggaaccccaggcggagtcggagcccctgctgggcggggcccgcggcggtggcggcgactggccggcggggctgaccacttaccgcagcatccaagtcggccctggtgccgcggccaggtgggacctctgcattgatcaggctgtggtcttcatcgaagatgctattcagtaccgctccatcaaccaccgggtggatgccagctcgatgtggctttaccgacggtattactcgaacgtatgccaacggactttgagcttcaccatcttcttgatcctgtttttggcttttatcgagaccccatcctcactcaccagcacggcggacgtgcgctaccgcgctgctccctgggagccgccctgcggcctgaccgagagtgtcgaggtgctctgcctgctggtctttgcggccgacctctctgtgaagggttacctgttcgggtgggcccatttccagaaaaacctttggctgctgggctacctcgtggtgctggtggtgtctctggtggactggaccgtgtccctgagtctcgtgtgtcatgagcccctgcggatccgccggcttctccgtcccttcttcctgctgcagaactcctctatgatgaagaagaccttgaaatgcatccgctggtcgctgccggaaatggccagcgtcgggctgctgctggccatccacctgtgcctcttcaccatgttcggaatgctgctgttcgctggtgggaagcaggatgatgggcaggacagggagaggctgacctacttccagaacctgcctgagtctctgacttccctcctggtgctgctgaccacggccaacaaccccgatgtgatgattcctgcgtattccaagaaccgggcctatgccatcttcttcatagtcttcactgtgataggaagcctgtttctgatgaacctgctgacagccatcatctacagtcagttccggggctacctgatgaaatctctccagacctcgctgtttcggaggcggctgggaacccgggctgcctttgaagtcctatcctccatggtgggggagggaggagccttccctcaggcagttggggtgaagccccagaacttgctgcaggtgcttcagaaggtccagctggacagctcccacaaacaggccatgatggagaaggtgcgttcctatggcagtgttctgctctcagctgaggagtttcagaagctcttcaacgagcttgacagaagtgtggttaaagagcacccgccgaggcccgagtaccagtctccgtttctgcagagcgcccagttcctcttcggccactactactttgactacctggggaacctcatcgccctggcaaacctggtgtccatttgcgtgttcctggtgctggatgcagatgtgctgcctgctgagcgtgatgacttcatcctggggattctcaactgcgtcttcattgtgtactacctgttggagatgctgctcaaggtctttgccctgggcctgcgagggtacctgtcctaccccagcaacgtgtttgacgggctcctcaccgttgtcctgctgaacttccttcacaagtgggacccccgcagccacctgcagccccttgctgggaccccagaggccacctaccagatgactgtggagctcctgttcagggatattctggaggagcccggggaggatgagctcacagagaggctgagccagcacccgcacctgtggctgtgcaggtgacgtccgggctgccgtcccagcaggggcggcaggagagagaggctggcctacacaggtgcccgtcatggaagaggcggccatgctgtggccagccaggcaggaagagacctttcctctgacggaccactaagctggggacaggaaccaagtcctttgcgtgtggcccaacaaccatctacagaacagctgctggtgcttcagggaggcgccgtgccctccgctttcttttatagctgcttcagtgagaatt

SEQ ID NO: 196660 - DNA, 2914 bp, Homo sapiens
  Payload ID: 18790
  Gene Name: TXK tyrosine kinase
  Uniprot ID: P42681
  ENST ID: ENST00000264316
  CDS Start-End: 87-1670
gatttcagttgaaagatgtgtttttgtgagtagagcaccgcagaagaactgaagactgttgtgtgctccccgcagaaggggctaccatgatcctttcctcctataacaccatccagtcggttttctgttgctgctgttgctgttcagtgcagaagcgacaaatgagaacacagataagcctgagcacagatgaagagcttccagaaaaatacacccagcgtcgcaggccgtggctcagccaattgtcaaataagaagcaatccaacacgggccgtgtgcagccgtcaaaacgaaagccactgcctcccctcccaccctctgaggttgctgaagagaagatccaagtcaaggcactttatgattttctgcccagagaaccctgtaatttagccttaaggagagcagaagaatacctgatactggagaaatacaatcctcactggtggaaggcaagagaccgtttggggaatgaaggcttaatcccaagcaactatgtgactgaaaacaaaataactaatttagaaatatatgagtggtaccatagaaacattaccagaaatcaggcagaacatctattgagacaagagtctaaagaaggtgcatttattgtcagagattcaagacatttaggatcctacacaatttccgtatttatgggagctagaagaagtacggaggctgccataaaacattatcagataaaaaagaatgactcaggacagtggtatgtggctgaaagacacgcctttcaatcaatccctgagttaatctggtatcaccagcacaatgcagccggtctcatgactcgtctccgatatccagttgggctgatgggcagttgtttaccagccacagctgggtttagctacgaaaagtgggagatagatccatctgagttggcttttataaaggagattggaagcggtcagtttggagtggtccatttaggtgaatggcggtcacatatccaggtagctatcaaggccatcaatgaaggctccatgtctgaagaggatttcattgaagaggccaaagtgatgatgaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggtacgttttggatgatgagtatgtcagttcttttggagccaagttcccaatcaagtggtcccctcctgaagtttttcttttcaataagtacagcagtaaatctgatgtctggtcatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgccgagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgacattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaattttcaggaagatgatttgttctttccagaagaggagacaaaagcaagatagccaaatgtgacatcaagctccattgtttcggaaatccaggattttgaattcgagatgaaacaaccagcaatcacagttaaatcttaactttgcctgcactctttgtaggaatgatcagaaatttatctttatcattctgagtgcttcaggagtacaataggaagaaagatactggagaaagcactaatgtaatcaccatgaagtctgacaacaggagcccattatttgcgtactgtcccaccctgtatcatggttctctgggaacaagctttatgattctcattagagtttatttgttgattgtcagtagttgcgacttttaaattatatttcccccactcaaagaatggtatctttatatatcaatgacattcaataaatgtgtattatttctaatgagaa

SEQ ID NO: 196661 - DNA, 1407 bp, Homo sapiens
  Payload ID: 18790
  Gene Name: TXK tyrosine kinase
  ENST ID: ENST00000514937
  CDS Start-End: 18-266
acattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgccgagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgacattcatcacttcagtgatccatgcatagaatatgaaaataaattcttccaactcatgggataaaggggactcccttgaagaatttcatgtttttgggctgtatagctctttacagaaaatgcacctttataaatcacatgaatgttagtattctggaaatgtcttttgttaatataatcttcccatgttatttaacaaattgtttttgcacatatctgattatattgaaagcagttttttgcattcgagttttaaacactgttataaaatgtagccaaagctcacctttgaacagatcccggtgacattctatttccaggaaaatccggaacctgattttagttctgtgattttacactttttacatgtgagattggacagtttcagaggccttattttgtcatactaagtgtctcctgtaattttcaggaagatgatttgttctttccagaagaggagacaaaagcaagatagccaaatgtgacatcaagctccattgtttcggaaatccaggattttgaattcgagatgaaacaaccagcaatcacagttaaatcttaactttgcctgcactctttgtaggaatgatcag

SEQ ID NO: 196662 - DNA, 542 bp, Homo sapiens
  Payload ID: 18790
  Gene Name: TXK tyrosine kinase
  ENST ID: ENST00000506073
  CDS Start-End: 128-542
ttatttgtcttccactagtgaaggaaggcacgatcgagactttcatacgctttataataattcgtctcacccttcccttagagactccctcaatatcacgtactcatggctttctaacagctgagaaatgatctgcttttcagataacaccatccagtcggttttctgttgctgctgttgctgttcagtgcagaagcgacaaatgagaacacagataagcctgagcacagatgaagagcttccagaaaaatacacccagcgtcgcaggccgtggctcagccaattgtcaaataagaagcaatccaacacgggccgtgtgcagccgtcaaaacgaaagccactgcctcccctcccaccctctgaggttgctgaagagaagatccaagtcaaggcactttatgattttctgcccagagaaccctgtaatttagccttaaggagagcagaagaatacctgatactggagaaatacaatcctcactggtggaaggcaagagaccgtttggggaatgaaggcttaatcccaagcaactatgtgactg

SEQ ID NO: 196663 - DNA, 1153 bp, Homo sapiens
  Payload ID: 18790
  Gene Name: TXK tyrosine kinase
  ENST ID: ENST00000507351
  CDS Start-End: 129-677
aaaaatgcaaacacaattctgctcactggtgtatgtttttcttcaccaggaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggcggcaaggaattgtttggtcagttcaacatgcatagtaaaaatttcagactttggaatgacaaggtacgttttggatgatgagtatgtcagttcttttggagccaagttcccaatcaagtggtcccctcctgaagtttttcttttcaataagtacagcagtaaatctgatgtctggtcatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgccgagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaagaagtgaaaaagacttcgcagcagtcttcattgtggtgctcttcatgatcatagccccaggaacccttgaggttcttcttcacaaggctgagagtgcttccttcttgaagacgagtgacattcatcacttcagtgatccatgcatagaatatgaaaataaattcttccaactcatgggataaaggggactcccttgaagaatttcatgtttttgggctgtatagctc

SEQ ID NO: 196664 - DNA, 743 bp, Homo sapiens
  Payload ID: 18790
  Gene Name: TXK tyrosine kinase
  ENST ID: ENST00000509681
  CDS Start-End: 130-276
taaaaatgcaaacacaattctgctcactggtgtatgtttttcttcaccaggaaattatctcattcaaagctagtgcaactttatggagtctgtatacagcggaagcccctttacattgtgacagagttcatggaaaatggctgcctgcttaactatctcagggagaataaaggaaagcttaggaaggaaatgctactgagtgtatgccaggatatatgtgaaggaatggaatatctggagaggaatggctatattcatagggatttggagttttaatgtgggaagtttttacagaaggaaaaatgccttttgaaaataagtcaaatttgcaagtcgtggaagctatttctgaaggcttcaggctatatcgccctcacctggcaccaatgtccatatatgaagtcatgtacagctgctggcatgagaaacctgaaggccgccctacatttgccgagctgctgcgggctgtcacagagattgcggaaacctggtgaccggaaacagaatgccaacccaaagagtcatcttgcaaaactgtcatttattgtgaatatcttcaccatatggggtcacttatggtgaatatctttcttcagagttgctgactcttgaaaacagtgcaaagatcacagtttttaaaagttttaaaaatttaagaatattcacacaatcgtttttctatgtgtgagagggatttgcacactcttatttttctgtaaaatatttcacatcccaaatgtgaa

SEQ ID NO: 196665 - DNA, 568 bp, Homo sapiens
  Payload ID: 18791
  Gene Name: TYRO protein tyrosine kinase binding protein
  Uniprot ID: O43914
  ENST ID: ENST00000262629
  CDS Start-End: 68-409
acttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagc

SEQ ID NO: 196666 - DNA, 541 bp, Homo sapiens
  Payload ID: 18791
  Gene Name: TYRO protein tyrosine kinase binding protein
  ENST ID: ENST00000424586
  CDS Start-End: 68-373
acttgcctggacgctgcgccacatcccaccggcccttacactgtggtgtccagcagcatccggcttcatggggggacttgaaccctgcagcaggctcctgctcctgcctctcctgctggctgtaagtgattgcagttgctctacggtgagcccgggcgtgctggcagggatcgtgatgggagacctggtgctgacagtgctcattgccctggccgtgtacttcctgggccggctggtccctcgggggcgaggggctgcggaggcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaca

SEQ ID NO: 196667 - DNA, 522 bp, Homo sapiens
  Payload ID: 18791
  Gene Name: TYRO protein tyrosine kinase binding protein
  Uniprot ID: O43914
  ENST ID: ENST00000544690
  CDS Start-End: 48-356
acatcccaccggcccttacactgtggtgtccagcagcatccggcttcatggggggacttgaaccctgcagcaggctcctgctcctgcctctcctgctggctgtaagtgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaa

SEQ ID NO: 196668 - DNA, 570 bp, Homo sapiens
  Payload ID: 18791
  Gene Name: TYRO protein tyrosine kinase binding protein
  ENST ID: ENST00000587837
  CDS Start-End: 68-175
acttgcctggacgctgcgccacatcccaccggcccttacactgtggtgtccagcagcatccggcttcatggggggacttgaaccctgcagcaggctcctgctcctgcctctcctgctggctgtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaca

SEQ ID NO: 196669 - DNA, 522 bp, Homo sapiens
  Payload ID: 18791
  Gene Name: TYRO protein tyrosine kinase binding protein
  ENST ID: ENST00000586946
  CDS Start-End: 68-175
acttgcctggacgctgcgccacatcccaccggcccttacactgtggtgtccagcagcatccggcttcatggggggacttgaaccctgcagcaggctcctgctcctgcctctcctgctggctgtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccaga

SEQ ID NO: 196670 - DNA, 415 bp, Homo sapiens
  Payload ID: 18791
  Gene Name: TYRO protein tyrosine kinase binding protein
  Uniprot ID: O43914
  ENST ID: ENST00000589517
  CDS Start-End: 68-406
acttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcgacccggaaacagcgtatcactgagaccgagtcgccttatcaggagctccagggtcagaggtcggatgtctacagcgacctcaacacacagaggccgtattacaaatgagcccgaatc

SEQ ID NO: 196671 - DNA, 620 bp, Homo sapiens
  Payload ID: 18791
  Gene Name: TYRO protein tyrosine kinase binding protein
  ENST ID: ENST00000585901
  CDS Start-End: 20-454
tccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggggatggtaatggaggtgctgatttggaatgacaaaacaccctcaactcaccactctgcctgtctctgcaccccacaacacccctcacctccagcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaa

SEQ ID NO: 196672 - DNA, 8207 bp, Homo sapiens
  Payload ID: 18792
  Gene Name: TYRO3 protein tyrosine kinase
  Uniprot ID: Q06418
  ENST ID: ENST00000263798
  CDS Start-End: 225-2897
gcggtggcgcgggagcggccccggggaccccgcgctgctgacggcggcgaccgcggccggaggcgggcgcgggtctcggaggcggtcgcctcagcaccgccccacgggcggccccagcccctcccgcagccctcctccctcccgctcccttcccgccgcctcctccccgccctcctccctcctcgctcgcgggccgggcccggcatggtgcggcgtcgccgccgatggcgctgaggcggagcatggggcggccggggctcccgccgctgccgctgccgccgccaccgcggctcgggctgctgctggcggctctggcttctctgctgctcccggagtccgccgccgcaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaagacctaaggttttgtctctttttttttttctttttttttgagacagtctcactgtgttgcccaggctggagtgcatggtgtgatcttggttcactgcaacctctgcctcctgggttcaagcgattcttgtgcctcagtcaccagagtagctgggattacaggggctcactaccatgcccaggtaatttttgtatttttagtagagatgtggtttcgccatgttggccagggtggtcttgaactcatgacctcaagtgatctgcctgccttggcctcccaaagtgctgggattacagtcctgagccaccacacctggccccagctttgtctcttaaatgtttactttttttgagatcacaaagatgaaagatttttatagagagaaaagtctggaaagacatatgccaaaatgttaacagctgttatctttttttttttttttttgagaccgagtctcactctgtcgcccaggctggagtgcaattgcgcgatctgagctcactgcaagctctgcctcccaggttcacgccattctcctgcctcagcctcccgagtagctgggactacaggtgcctgccaccacgcccggctaattttttgtatttttagtagagatagggtttcaccgtattagccaggatgatctcaatctcctgacctcgtgatccgcctgcctcagcctcccaaagtgttgggattacaggcgtgagccaccgcacctggcaacagctgttacctttaaatgatggggttaaggggacgttcttctttgtgctttccaagttttctgcattgagcacaaaatgcttttgtaattagatacaggatcccaatgaatcttattatactgaagataatacagagtcaccgtgggcagttagaaaaatgcaaaaaatcggctgggcgcagtggctcacgcctgtaatcccagcactttgggagacctgggtgtgtggatcacgaggtcagaagttcaagactagtctgaccaacatggtgacaccccgtctttactaaaaatacaaaaattagctgggcatggtggcgcgtgtctgtaatcccagctactcaggacactgaggcaggagaattgcttgaactcaggaggcggaggttgcagtgagtcgagatcccggcagcctaggtgacaggcgagactccatctcaaaaataaaataaaaataaaaatgcaaaaaataataaaaggtgccagttacctatactcccaccacctagagataatcaccattgatcttttgaaaatgcaaatattcagctgggcacagtggcgtgtatttttttttttttttgagacggagtctcgagtctctctctgtcgcccaggctagagtgcagtggtgtgatctcggctcactgtaacctctgtctcccaggtttaatcaagtctcttgtcttggcttcccgagtagttgggactacaggcacgagccactgtgtccggctattttttgtatttttttgtagagacagggtttcgccatgttggccaggctggtctcgaactcctgatttcaagtgatctgcctgccttagcctcccaaagtgctgtgataacaggggtgagacaccatacccagcttgtaatcccagcactttgggaggctgaggcgggtggatcacttcaggccgggagttcgagaccagcctgggcaacatgaaaccccatctcaactaaaaattcaaaaaagtttagccaggcttggtggcgcaggtttgtcatctcagctactgggtgactgaggcatgagaatcacttaaacctgggaggaggaggttgcagtaagctgagatcttgccactaaacttcggcctgggtgacagattaagactgtctcagaaacaaaacaaaacaacaaaaaagcttttagagcaagttcatgggagatgcagcaggaggcgcaggaaccacacatgtgctagtgaggagtgtggggagactgggagggcccacaggtattgtgctgcttctggctgagggcaggggaatagggtggctgcttctgaaagcaaatatcctgaaaaacctgttgctggtactccaaattctggttcccatgtagatcatgaaacctgaaaaacttccaggcaagtagctttcagaatctttcctgctgtgattagctttcactgcaggtagtgattacctgtgagataacatctgggaattattgattgaaaagaccttcactatcggttgggggcggtggctgatgcctgtaatcccagcactttgtgaggctgaggcgggtggatcacctgaggtcaggggttcaagaccagcctggccaacatggtgaaaccccatctctactaaaaaatacaaaaactagccaggagtggtggcaggcacctgtaatcccagctacttgggaggctaaggcaggagaatcacttgaaccctggaggcggaggttgcagtgaactgagatggcaccagtgcactccagcctgggtgacagagcgagactccatctcaaaaaaaaaaaaaaaaaaaagaggccaggcatggtggctcacgcctataatcccagcgctttgggattttctgtctcaaaaaaaaaaagagagagactctggatcaaaaaggattttcacaaacagatccaaagaaccagcatccagattaagaaacagcattaacagcaacccagaagcaacccttgggacctgcctcaatctctgcctcctccctactccccataggtaacctctatcctgacctcttaacaccatggatcagtgaagctccttttaaaagtatataaatggagtcatgtagatttgattactttgcgtttggcttctttccctcagcaacatgtttataaggatcatctaacaacagcagttttgaaaagtgagtctcaaagaggcaagaatggccgggcatggtggctcacacccgtaatcccagcgctttgggaggccgaggcgggcggatcacaaggtcaggagtttgagaccagcctggctaacagggtgaaaccctgtctttactaaaccctgtctttactaaaaatacacaaaattagccaggtatggtggcaggcacgtgtaatcctagctactcgggaggctgaggcaggagaatcacttgaacctgggagggggaggttgcagtgagccactacattccagcttgggtgagagagtgagactccatctcggaaaaaaaaaaaattagctgggcgtgctggtgggtgcctgtaatcccagctacttgggaggctgaggtaggagaattgcttgaacctgggaggtggaagttgctgtgagacgagattgtgccatggcactccagcctggacaagagtgagactccatctcaaaaaagaaaataataataatatagtttatttttcagtatttcatgttgatttatctcaaatttattgttgaataagaagtgatacagagattcaaagttatttttcccagatactttttattgtcccaataccaccatttattgaacaatctatattttatgcacatttcttttttttttcttttttttgatacagggtcttgctctgtttctgcctgggctggagtaaagtgatagtaaactgattctcccacctcagcgtcctgaatagctgggaccacaggcacacgccactgcacctggcaaatttttaagtgtttttttttttttttaatacagagccttgctctgtcgcccaggctggagtgcagtggtgtgatctcggctcactgcaacctccgcctctcagttcaagcgagtctcctcctgcctcacactcccaattagctgggactacaggcacgtgccaccacaacatgctaattttttgtatttttagtagagacagggtttcaccatgttagccaggatggtctcgatctcctgacctcgtgatctgcccgcctcagcctcccaaagtgctgggattacaggcttcagccaccgcgcccggcccagtttttaagtgttgtagagatggagtcttgctttgttgcccaggctggtcttgaactctgggctgaagcgatctgcccaccttggcctctcaaagtgcggagattacaggtgtgagccaccacacccagccagaatttcttgaataatctgtctccatttctctatatagcctcattgatctatctaaactcccatatctattttggttgctagactgttcatcccaattacatgtgccagtgtcactgctacactaattgaattactataaatgtataatgttttcct

SEQ ID NO: 196673 - DNA, 547 bp, Homo sapiens
  Payload ID: 18792
  Gene Name: TYRO3 protein tyrosine kinase
  ENST ID: ENST00000559851
  CDS Start-End: 1-66
gtgaagatgctgaaaggggcacatcttgttttatttcctccttccccatccccttctcctagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtg

SEQ ID NO: 196674 - DNA, 535 bp, Homo sapiens
  Payload ID: 18792
  Gene Name: TYRO3 protein tyrosine kinase
  ENST ID: ENST00000559815
  CDS Start-End: 1-365
gctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccaca

SEQ ID NO: 196675 - DNA, 3876 bp, Homo sapiens
  Payload ID: 18792
  Gene Name: TYRO3 protein tyrosine kinase
  ENST ID: ENST00000559066
  CDS Start-End: 810-3347
aagaaagaaacagagacagagatatctggcccctgccatccatgtcttgacagtgcctcatgagtctctcctcctgctgccgcctgggggcgcccccagctgggtctcaggctgctgccagcactgctgttgttatcattagggtaattaataaacaagcactgctggggccaagtggaagaagaggcaggcccctgctgctcaggagaatccctgaaaagatccagtgagcctgcggcaaccggagctgagtggctggtccctcctctctacccaggacctctggaaggggtgtggggtgggcttccccctggagggaagggcaaggggaggagcacacttggtaggcttggtttggaaccagctctgcatgtgcctaacaggatgtctgtgggcaaggccaccctcgtgattactggttgtggggcaggctctgaagcaattattcattcatttaacaggcatctgcctatttatttatggaaagcctactgtgtgcaaggtggtctactaataatagctaatgtttgactggacagtgtgacgacacagccaactttcacaccaggtcctgggaaaaggggtagaagcaggggaagcaaccaggaaaaatgacagcccaaaaagatacgggcaattaggctttggcctgtgtagtgtagtggtggggatatatattaggtaaaacctggggattaccaagatcttgggaaactcaggacccaagttggaaaacatacggcaattggggctggagaaaatgggcatttttcaggtgggagggacttggagataaaggtctgaagctcatgggagccccggtgaagctgacagtgtctcaggggcagccggtgaagctcaactgcagtgtggaggggatggaggagcctgacatccagtgggtgaaggatggggctgtggtccagaacttggaccagttgtacatcccagtcagcgagcagcactggatcggcttcctcagcctgaagtcagtggagcgctctgacgccggccggtactggtgccaggtggaggatgggggtgaaaccgagatctcccagccagtgtggctcacggtagaaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggggtgacccagagcaccatgttttcctgtgaagctcacaacctaaaaggcctggcctcttctcgcacagccactgttcaccttcaagcactgcctgcagcccccttcaacatcaccgtgacaaagctttccagcagcaacgctagtgtggcctggatgccaggtgctgatggccgagctctgctacagtcctgtacagttcaggtgacacaggccccaggaggctgggaagtcctggctgttgtggtccctgtgcccccctttacctgcctgctccgggacctggtgcctgccaccaactacagcctcagggtgcgctgtgccaatgccttggggccctctccctatgctgactgggtgccctttcagaccaagggtctagccccagccagcgctccccaaaacctccatgccatccgcacagattcaggcctcatcttggagtgggaagaagtgatccccgaggcccctttggaaggccccctgggaccctacaaactgtcctgggttcaagacaatggaacccaggatgagctgacagtggaggggaccagggccaatttgacaggctgggatccccaaaaggacctgatcgtacgtgtgtgcgtctccaatgcagttggctgtggaccctggagtcagccactggtggtctcttctcatgaccgtgcaggccagcagggccctcctcacagccgcacatcctgggtacctgtggtccttggtgtgctaacggccctggtgacggctgctgccctggccctcatcctgcttcgaaagagacggaaagagacgcggtttgggcaagcctttgacagtgtcatggcccggggagagccagccgttcacttccgggcagcccggtccttcaatcgagaaaggcccgagcgcatcgaggccacattggacagcttgggcatcagcgatgaactaaaggaaaaactggaggatgtgctcatcccagagcagcagttcaccctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaacctacccctccagaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgtgtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtc

SEQ ID NO: 196676 - DNA, 856 bp, Homo sapiens
  Payload ID: 18792
  Gene Name: TYRO3 protein tyrosine kinase
  ENST ID: ENST00000568343
  CDS Start-End: 1-856
cctgggccggatgttgggcaaaggagagtttggttcagtgcgggaggcccagctgaagcaagaggatggctcctttgtgaaagtggctgtgaagatgctgaaagctgacatcattgcctcaagcgacattgaagagttcctcagggaagcagcttgcatgaaggagtttgaccatccacacgtggccaaacttgttggggtaagcctccggagcagggctaaaggccgtctccccatccccatggtcatcttgcccttcatgaagcatggggacctgcatgccttcctgctcgcctcccggattggggagaacccctttaccctgatccggttcatggtggacattgcctgcggcatggagtacctgagctctcggaacttcatccaccgagacctggctgctcggaattgcatgctggcagaggacatgacagtgtgtgtggctgacttcggactctcccggaagatctacagtggggactactatcgtcaaggctgtgcctccaaactgcctgtcaagtggctggccctggagagcctggccgacaacctgtatactgtgcagagtgacgtgtgggcgttcggggtgaccatgtgggagatcatgacacgtgggcagacgccatatgctggcatcgaaaacgctgagatttacaactacctcattggcgggaaccgcctgaaacagcctccggagtgtatggaggacgttcttacactcccactccatccaagccaagggctccctaggccttcagacaaccttttgtatgatctcatgtaccagtgctggagtgctgaccccaagcagcgcccgagctttacttgtctgcgaatggaactggagaacatcttg

SEQ ID NO: 196677 - DNA, 2485 bp, Homo sapiens
  Payload ID: 18793
  Gene Name: tyrosinase
  Uniprot ID: P14679
  ENST ID: ENST00000263321
  CDS Start-End: 503-2092
tattgagttcttcaaacattgtagcctctttatggtctctgagaaataactaccttaaacccataatctttaatacttcctaaactttcttaataagagaagctctattcctgacactacctctcatttgcaaggtcaaatcatcattagttttgtagtctattaactgggtttgcttaggtcaggcattattattactaaccttattgttaatattctaaccataagaattaaactattaatggtgaatagagtttttcactttaacataggcctatcccactggtgggatacgagccaattcgaaagaaaagtcagtcatgtgcttttcagaggatgaaagcttaagataaagactaaaagtgtttgatgctggaggtgggagtggtattatataggtctcagccaagacatgtgataatcactgtagtagtagctggaaagagaaatctgtgactccaattagccagttcctgcagaccttgtgaggactagaggaagaatgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacagtatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcagacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataaaaggcttaggcaatagagtagggccaaaaagcctgacctcactctaactcaaagtaatgtccaggttcccagagaatatctgctggtatttttctgtaaagaccatttgcaaaattgtaacctaatacaaagtgtagccttcttccaactcaggtagaacacacctgtctttgtcttgctgttttcactcagcccttttaacattttcccctaagcccatatgtctaaggaaaggatgctatttggtaatgaggaactgttatttgtatgtgaattaaagtgctcttattttaaaaaattgaaataattttgatttttgccttctgattatttaaagatctatatatgttttattggccccttctttattttaataaaacagtgagaaatcta

SEQ ID NO: 196678 - DNA, 872 bp, Homo sapiens
  Payload ID: 18794
  Gene Name: tyrosinase-related protein 1
  ENST ID: ENST00000381136
  CDS Start-End: 76-819
aaagactttccttggggtaggacaggaaagctttggtgaagtggatttctctcatgagggaccagcttttctcacatggcacaggtaccacctcctgcgtctggagaaagacatgcaggcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatat

SEQ ID NO: 196679 - DNA, 2851 bp, Homo sapiens
  Payload ID: 18794
  Gene Name: tyrosinase-related protein 1
  Uniprot ID: P17643
  ENST ID: ENST00000388918
  CDS Start-End: 130-1743
aattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagcattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtaagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataatcatgcactatagaaaa

SEQ ID NO: 196680 - DNA, 549 bp, Homo sapiens
  Payload ID: 18794
  Gene Name: tyrosinase-related protein 1
  ENST ID: ENST00000473763
  CDS Start-End: 243-549
ataaaagttatctcactaaatacttgagactcaaagtgatatacttcacttttccatacagcctgcagacaaaacccatcatatagctctgcctagctacaaggggatggcaaaatataatcccatatatctgaaaggagagaagaaccagatatggctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacg

SEQ ID NO: 196681 - DNA, 3049 bp, Homo sapiens
  Payload ID: 18795
  Gene Name: tyrosine 3-monooxygenase/tryptophan 5-monooxygenase activation protein, beta
  Uniprot ID: P31946
  ENST ID: ENST00000353703
  CDS Start-End: 215-955
aggaccggagcggaagtggcgatcggagcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 196682 - DNA, 3109 bp, Homo sapiens
  Payload ID: 18795
  Gene Name: tyrosine 3-monooxygenase/tryptophan 5-monooxygenase activation protein, beta
  Uniprot ID: P31946
  ENST ID: ENST00000372839
  CDS Start-End: 275-1015
ggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcctgtgaa

SEQ ID NO: 196683 - DNA, 556 bp, Homo sapiens
  Payload ID: 18795
  Gene Name: tyrosine 3-monooxygenase/tryptophan 5-monooxygenase activation protein, beta
  ENST ID: ENST00000445830
  CDS Start-End: 334-556
agtcgccgccgccgccgccgctgcagccactgcaggcaccgctgccgccgcctgagtagtgggcttaggaaggaagaggtcatctcgctcggagcttcgctcggaagggtctttgttccctgcagccctcccacgatagcatcaggtcctgattttgcttgccctgtgtgggagatggaatttggcaagatgatgctatgaacataaaatcagcctcgggaaccaaaagagaaaggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatg

SEQ ID NO: 196684 - DNA, 648 bp, Homo sapiens
  Payload ID: 18795
  Gene Name: tyrosine 3-monooxygenase/tryptophan 5-monooxygenase activation protein, beta
  ENST ID: ENST00000428262
  CDS Start-End: 349-648
cggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctg

SEQ ID NO: 196685 - DNA, 1097 bp, Homo sapiens
  Payload ID: 18795
  Gene Name: tyrosine 3-monooxygenase/tryptophan 5-monooxygenase activation protein, beta
  ENST ID: ENST00000479421
  CDS Start-End: 189-638
agcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacgggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctgtttttcaggatgccacattctaaaacaactcttcgaaaatattgctctgtatacgaagcttggactccttcagaactacttttgttgagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaa

SEQ ID NO: 196686 - DNA, 689 bp, Homo sapiens
  Payload ID: 18795
  Gene Name: tyrosine 3-monooxygenase/tryptophan 5-monooxygenase activation protein, beta
  ENST ID: ENST00000633979
  CDS Start-End: 1-244
agccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtacatctggtattcagatgaagtatgtcatgcattccaagggcaagaaagttccataattcatgaaatgtagaccaacttttaagagcatctgaaagaatgtgaagaagagcttggtacttactgcctcttaaccagtttttcaggatgccacattctaaaacaactcttcgaaaatattgctctgtatacgaagcttggactccttcagaactacttttgttgagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttacta

SEQ ID NO: 196687 - DNA, 2211 bp, Homo sapiens
  Payload ID: 18796
  Gene Name: tyrosine 3-monooxygenase/tryptophan 5-monooxygenase activation protein, epsilon
  Uniprot ID: P62258
  ENST ID: ENST00000264335
  CDS Start-End: 269-1036
gctccggcgcccgctgagccgacagaggagaggcgtctcgtgcgctcgttccagccgcttcgggcgccgagttccaggacccgccccccgcgccagttgccagggagcggttgccatagagctgagcagttgtccgcgtgcgcaggcggaagtcccggattgaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtacaa

SEQ ID NO: 196688 - DNA, 780 bp, Homo sapiens
  Payload ID: 18796
  Gene Name: tyrosine 3-monooxygenase/tryptophan 5-monooxygenase activation protein, epsilon
  ENST ID: ENST00000573026
  CDS Start-End: 72-188
agaggctgagagagtcggagacactatccgcttccatccgtcgcgcagaccctgccggagccgctgccgctatggatgatcgagaggatctggtgtaccaggcgaagctggccgagcaggctgagcgatacgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaa

SEQ ID NO: 196689 - DNA, 540 bp, Homo sapiens
  Payload ID: 18796
  Gene Name: tyrosine 3-monooxygenase/tryptophan 5-monooxygenase activation protein, epsilon
  ENST ID: ENST00000575977
  CDS Start-End: 105-428
gcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaat

SEQ ID NO: 196690 - DNA, 1818 bp, Homo sapiens
  Payload ID: 18796
  Gene Name: tyrosine 3-monooxygenase/tryptophan 5-monooxygenase activation protein, epsilon
  Uniprot ID: P62258
  ENST ID: ENST00000571732
  CDS Start-End: 210-911
attgaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgtgctctggaactgaacccgcagtatcttccaagaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaa

SEQ ID NO: 196691 - DNA, 739 bp, Homo sapiens
  Payload ID: 18796
  Gene Name: tyrosine 3-monooxygenase/tryptophan 5-monooxygenase activation protein, epsilon
  ENST ID: ENST00000573196
  CDS Start-End: 97-381
atttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagag

SEQ ID NO: 196692 - DNA, 1377 bp, Homo sapiens
  Payload ID: 18796
  Gene Name: tyrosine 3-monooxygenase/tryptophan 5-monooxygenase activation protein, epsilon
  ENST ID: ENST00000466227
  CDS Start-End: 1-329
aaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaa

SEQ ID NO: 196693 - DNA, 732 bp, Homo sapiens
  Payload ID: 18796
  Gene Name: tyrosine 3-monooxygenase/tryptophan 5-monooxygenase activation protein, epsilon
  ENST ID: ENST00000496706
  CDS Start-End: 1-348
ggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacgattcctaaaggaaaacccaactcttcctttcctaaaaactctactttgtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccag

SEQ ID NO: 196694 - DNA, 1818 bp, Homo sapiens; identical to SEQ ID NO: 196690
  Payload ID: 18796
  Gene Name: tyrosine 3-monooxygenase/tryptophan 5-monooxygenase activation protein, epsilon
  Uniprot ID: P62258
  ENST ID: ENST00000616643
  CDS Start-End: 210-911

SEQ ID NO: 196695 - DNA, 739 bp, Homo sapiens; identical to SEQ ID NO: 196691
  Payload ID: 18796
  Gene Name: tyrosine 3-monooxygenase/tryptophan 5-monooxygenase activation protein, epsilon
  ENST ID: ENST00000630606
  CDS Start-End: 97-381

SEQ ID NO: 196696 - DNA, 780 bp, Homo sapiens; identical to SEQ ID NO: 196688
  Payload ID: 18796
  Gene Name: tyrosine 3-monooxygenase/tryptophan 5-monooxygenase activation protein, epsilon
  ENST ID: ENST00000628106
  CDS Start-End: 72-188

SEQ ID NO: 196697 - DNA, 1377 bp, Homo sapiens; identical to SEQ ID NO: 196692
  Payload ID: 18796
  Gene Name: tyrosine 3-monooxygenase/tryptophan 5-monooxygenase activation protein, epsilon
  ENST ID: ENST00000629090
  CDS Start-End: 1-329

SEQ ID NO: 196698 - DNA, 2208 bp, Homo sapiens
  Payload ID: 18796
  Gene Name: tyrosine 3-monooxygenase/tryptophan 5-monooxygenase activation protein, epsilon
  Uniprot ID: P62258
  ENST ID: ENST00000627231
  CDS Start-End: 269-1036
gctccggcgcccgctgagccgacagaggagaggcgtctcgtgcgctcgttccagccgcttcgggcgccgagttccaggacccgccccccgcgccagttgccagggagcggttgccatagagctgagcagttgtccgcgtgcgcaggcggaagtcccggattgaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacgaaatggtggagtcaatgaagaaagtagcagggatggatgtggagctgacagttgaagaaagaaacctcctatctgttgcatataagaatgtgattggagctagaagagcctcctggagaataatcagcagcattgaacagaaagaagaaaacaagggaggagaagacaagctaaaaatgattcgggaatatcggcaaatggttgagactgagctaaagttaatctgttgtgacattctggatgtactggacaaacacctcattccagcagctaacactggcgagtccaaggttttctattataaaatgaaaggggactaccacaggtatctggcagaatttgccacaggaaacgacaggaaggaggctgcggagaacagcctagtggcttataaagctgctagtgatattgcaatgacagaacttccaccaacgcatcctattcgcttaggtcttgctctcaatttttccgtattctactacgaaattcttaattcccctgaccgtgcctgcaggttggcaaaagcagcttttgatgatgcaattgcagaactggatacgctgagtgaagaaagctataaggactctacacttatcatgcagttgttacgtgataatctgacactatggacttcagacatgcagggtgacggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagta

SEQ ID NO: 196699 - DNA, 732 bp, Homo sapiens; identical to SEQ ID NO: 196693
  Payload ID: 18796
  Gene Name: tyrosine 3-monooxygenase/tryptophan 5-monooxygenase activation protein, epsilon
  ENST ID: ENST00000628059
  CDS Start-End: 1-348

SEQ ID NO: 196700 - DNA, 540 bp, Homo sapiens; identical to SEQ ID NO: 196689
  Payload ID: 18796
  Gene Name: tyrosine 3-monooxygenase/tryptophan 5-monooxygenase activation protein, epsilon
  ENST ID: ENST00000626999
  CDS Start-End: 105-428

SEQ ID NO: 196701 - DNA, 1825 bp, Homo sapiens
  Payload ID: 18797
  Gene Name: tyrosine 3-monooxygenase/tryptophan 5-monooxygenase activation protein, eta
  Uniprot ID: Q04917
  ENST ID: ENST00000248975
  CDS Start-End: 274-1014
gcaggcgtcgtcccgtcctcccatcccccagcgcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 196702 - DNA, 1879 bp, Homo sapiens
  Payload ID: 18797
  Gene Name: tyrosine 3-monooxygenase/tryptophan 5-monooxygenase activation protein, eta
  ENST ID: ENST00000397492
  CDS Start-End: 213-431
cgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggttgctggtaaaattcctcctagtgtccaagtggaggcagcttgtcttctgtcccagcattttggtgctcctcccgcccctactcctggctgcagtggcattcccttctgcggtggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatta

SEQ ID NO: 196703 - DNA, 502 bp, Homo sapiens
  Payload ID: 18797
  Gene Name: tyrosine 3-monooxygenase/tryptophan 5-monooxygenase activation protein, eta
  ENST ID: ENST00000420430
  CDS Start-End: 17-502
atactgccttcctgtaatgattgatgttcctcattctaccagcgtcacctggaggacagtgttggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctg

SEQ ID NO: 196704 - DNA, 822 bp, Homo sapiens
  Payload ID: 18797
  Gene Name: tyrosine 3-monooxygenase/tryptophan 5-monooxygenase activation protein, eta
  ENST ID: ENST00000443669
  CDS Start-End: 213-332
cgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgagacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcactctctctccacgttattttacgttttctgtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaa

SEQ ID NO: 196705 - DNA, 3750 bp, Homo sapiens
  Payload ID: 18798
  Gene Name: tyrosine 3-monooxygenase/tryptophan 5-monooxygenase activation protein, gamma
  Uniprot ID: P61981
  ENST ID: ENST00000307630
  CDS Start-End: 224-967
ggccgcagggggttgtccgtcagtggcacgcacagcagccgcagccgcctcgcgcccggtcccgcggtcgcagctccagccgcctcctccgcgcagccgccgcctcagctgctcgctctgtgggtcggtcctctccggcacttgggctccagtcgcgccctccaagcccttcaggccgccccagtgtcctcctccttctccggccagacccagccccgcgaagatggtggaccgcgagcaactggtgcagaaagcccggctggccgagcaggcggagcgctacgacgacatggccgcggccatgaagaacgtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgcca

SEQ ID NO: 196706 - DNA, 2208 bp, Homo sapiens
  Payload ID: 18799
  Gene Name: tyrosine 3-monooxygenase/tryptophan 5-monooxygenase activation protein, theta
  Uniprot ID: P27348
  ENST ID: ENST00000238081
  CDS Start-End: 157-894
cgggagggtcctcagctaaagccaaaagcagatcaaagtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaa

SEQ ID NO: 196707 - DNA, 2216 bp, Homo sapiens
  Payload ID: 18799
  Gene Name: tyrosine 3-monooxygenase/tryptophan 5-monooxygenase activation protein, theta
  Uniprot ID: P27348
  ENST ID: ENST00000381844
  CDS Start-End: 165-902
aaaagcgggcggcgggccgcattgtctgacggcgctccctctctgctttttgttctcgcctcgccgccccgcccctccgcagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtagcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacattttaaaactagcaaa

SEQ ID NO: 196708 - DNA, 665 bp, Homo sapiens
  Payload ID: 18799
  Gene Name: tyrosine 3-monooxygenase/tryptophan 5-monooxygenase activation protein, theta
  ENST ID: ENST00000446619
  CDS Start-End: 217-665
gtgaaggtgagcgcctgggtcggcccgcgggcttcctccggccgcgctcggattgagggccgggcggaggtgccgcccttgagagcagccggttgtcgatgccgctcccctcagggacggctccgggcgggaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttacca

SEQ ID NO: 196709 - DNA, 2829 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000353245
  CDS Start-End: 85-822
gcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 196710 - DNA, 812 bp, Homo sapiens
  Payload ID: 18800
  Gene Name: tyrosine 3-monooxygenase/tryptophan 5-monooxygenase activation protein, zeta
  ENST ID: ENST00000395948
  CDS Start-End: 216-722
cccctcgcgcagtcaccgagcgcagatcccgcgctctcgattggaacgcctccccatcactcagccacactcaggggctggacgcctcactcccgtttccgagccataaaaggtctaggaccgcttcccccgagccagcaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgttta

SEQ ID NO: 196711 - DNA, 964 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000395951
  CDS Start-End: 164-901
atgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccat

SEQ ID NO: 196712 - DNA, 994 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000395953
  CDS Start-End: 151-888
gcatggccggggcgccgccggccgcgatccatccccacccttgtctctgcgggcttccaccccctccctcgccgcccttctcgcttccgcccgagataatgactcggcggcggcggcggcgggcatcgcagtggcgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtt

SEQ ID NO: 196713 - DNA, 2974 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000395956
  CDS Start-End: 227-964
ccgccccctcccctctccctcggccgccccctcctttccctccccctcgcgcagcctccgcgctgggcgctgcggcggcgggacccggccctcccccaccccgggaggcggtggcgcggcggggaggggccgggggcctcggggacccaagcgcgagggaaaggcctggccgagagcgggccggagcccaggcctggcgcggcggcgcccgccagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaa

SEQ ID NO: 196714 - DNA, 5248 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000395957
  CDS Start-End: 343-1080
cgcagtcaccgagcgcagatcccgcgctctcgattggaacgcctccccatcactcagccacactcaggggctggacgcctcactcccgtttccgagccataaaaggtctaggaccgcttcccccgagccagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctgcatctagggcaacaatccttttccctcgcagctctttcttttacctcacttactgatttctcctgacccccaagccaaggaggtaaaataattatatatatatatatatatatatatatatatatataaagtaattatattttatagctagactgaagaggtgggaatttttttgttgttttttttttttttggagacaagagtcttgctctgtcacccaggcttgagtgcagtggtgcgatctcggctgagtgcaacctccgcctgctgggttcaagcgattctcctgcctcagcctcccaagtagctgggattacaggtgcccgccaccacacctggctaatttttgtgtttttagtagagacagggtttcaccatgttgtccaggctggtcttgaattcccgacctcaggcaatccgcccatctcaacctcccaaagtgctgggattacaggcataagccaccgcgcccagtagagatgtgatattattcaagtaaataaaacctgaaacttggcacatttgcctatttaatgtgcatcagtcatctgaactaggttgatcctggaataatgaaaacacttcactagtattaactaatgttttctacatagtagttcccaatagattaaggaaaatttccaacctgagattctttgttttggaatttgaataatgtgtttgtaactattccttgattgtcccaaatccaggctttacgtctgcttttgtcaatgtaacatcctagtgccaggaaattggaaaatccaatgactttttgtgtgtaaagtactggaatttttttgttcgtttgtttttaagacggagtgtcaactctcgcccaggctggggtgcagtggcctgatctcggctcactgcaaccttctcctcccaggctgaagtgattctcctgcctcagcctcgcaagtagctgggactgcaggcatgtgccaccactcctggctaattatttgtatttttagtagagagagggtttcaccgtgttagccatgatggtctcattctcctgaccttgtgatccgcccacctcggcctcccaaagtgctgggattacaggcgtgagccactgtgcccaccctggtatgttttttttaaattggccacttaagagttgtccttcagaaagtggagcagcagtgtgattagtaaaaacgatgggctttcctgcagctctggcttatggtctttgtttttccagttaacagctgttacttcatgctgttatagggggtggggggagaaagagaaagaatatgtctagtggcttaattttggggctcaatttgtttattatgtttttcctgcaaaagagtcaccagtcttgtcatggctcaatgcatattttaaaatgagtcaaagccaatttggaagctgctatcttaggttatttgtagtcaggcttcaaatggagagtgaaactttgactttgaaaactggtgctctatgctcaatgatggtcttacacattcctctagggaaaggtcaagaaataaatttggcttgattgtattctctcatttaccatataggaaatactatggtagaactgaaaatatgtacaatagtaaagtggtggctgagactgggcacttggaaaatagacttggattcttttctaagtgtgaaactaattaaatacttttatgtgactggtagtagtcacagtctccttgattgattctagttccttttcaaagtggagagacctgaatatagattgtaacaggatgtccaaccttgccagacaagcaggcatatatgtctctgggatgcagaagcagttacaagttaatatatttaagcataatgttagccaatcctaggtgataccagagatgtgaatatttgatcatatttgagttcattccttgaaagtccaaacctaactggtcttaattgattacttcttagtattccgaattttagaatttaaaaccctatgaattttcagtttgtgcttacattttctaacattggatgtttgctttggc

SEQ ID NO: 196715 - DNA, 3066 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000395958
  CDS Start-End: 213-950
gcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggag

SEQ ID NO: 196716 - DNA, 701 bp, Homo sapiens
  Payload ID: 18800
  Gene Name: tyrosine 3-monooxygenase/tryptophan 5-monooxygenase activation protein, zeta
  ENST ID: ENST00000437293
  CDS Start-End: 426-701
aaaaggtctaggaccgcttcccccgagccagcaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagat

SEQ ID NO: 196717 - DNA, 891 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000419477
  CDS Start-End: 103-840
gagcgggccggagcccaggcctggcgcggcggcgcccgccaggtagaccggggcgaggctgcgcgccggcgggaggggagtccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagacca

SEQ ID NO: 196718 - DNA, 3007 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000457309
  CDS Start-End: 156-893
tgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatgg

SEQ ID NO: 196719 - DNA, 996 bp, Homo sapiens
  Payload ID: 18800
  Gene Name: tyrosine 3-monooxygenase/tryptophan 5-monooxygenase activation protein, zeta
  ENST ID: ENST00000418997
  CDS Start-End: 703-996
agttactaccgcgaagcacggagggtggggcgggccgggcctcggggaggggtggggggatgtgaaaggtcccggatgttgctgaacgggagccccttccagagggagtgactggggcaagcgcagacgggctgagcgaaagctaaggtgggggtagggagagaacgccttcccgccggctgagaggaagagtgggccggcagaggctgcaggggagagggagagagagggcgttggggacccaaagggaaggcgaggagtgggggatttgcgttggggaggaaaaggaaaaaagcagcctcctgccctaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactg

SEQ ID NO: 196720 - DNA, 567 bp, Homo sapiens
  Payload ID: 18800
  Gene Name: tyrosine 3-monooxygenase/tryptophan 5-monooxygenase activation protein, zeta
  ENST ID: ENST00000523131
  CDS Start-End: 341-567
gcacggagggtggggcgggccgggcctcggggaggggtggggggatgtgaaaggtcccggatgttgctgaacgggagccccttccagagggagtgactggggcaagcgcagacgggctgagcgaaagctaagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaaca

SEQ ID NO: 196721 - DNA, 875 bp, Homo sapiens
  Payload ID: 18800
  Gene Name: tyrosine 3-monooxygenase/tryptophan 5-monooxygenase activation protein, zeta
  ENST ID: ENST00000522819
  CDS Start-End: 331-708
tcagcctcccgagtagctgggattacagtcgtgtgccaccacatccaatttttttttttttcccagtagagacggggtgtcacccaggctggtaatctttattttaaattgtacttgctcctaagaatttaggtgttaagagcatagcatgtagaaggaaaaaataaagctgctgtaacctcatcctgccttcttggagatgagaatctgagacccaggaagatttcagagttttgtcaaggtgacagagtttgaatttaggcatctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattagggg

SEQ ID NO: 196722 - DNA, 664 bp, Homo sapiens
  Payload ID: 18800
  Gene Name: tyrosine 3-monooxygenase/tryptophan 5-monooxygenase activation protein, zeta
  ENST ID: ENST00000523848
  CDS Start-End: 1-393
gtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatt

SEQ ID NO: 196723 - DNA, 511 bp, Homo sapiens
  Payload ID: 18800
  Gene Name: tyrosine 3-monooxygenase/tryptophan 5-monooxygenase activation protein, zeta
  ENST ID: ENST00000521328
  CDS Start-End: 100-511
agcccgcagtcggctcccgtgcttgatggactagaactggagggtccctgcgctcggtttggggacgcatatcctgctttgggggcggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgaca

SEQ ID NO: 196724 - DNA, 1399 bp, Homo sapiens
  Payload ID: 18800
  Gene Name: tyrosine 3-monooxygenase/tryptophan 5-monooxygenase activation protein, zeta
  ENST ID: ENST00000521309
  CDS Start-End: 158-535
acagagtctcagcctcgccgctgctgccgccgccgccgcccagagactgctgagcccgtccgtccgccgccaccacccactccggacacagtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaaca

SEQ ID NO: 196725 - DNA, 750 bp, Homo sapiens
  Payload ID: 18800
  Gene Name: tyrosine 3-monooxygenase/tryptophan 5-monooxygenase activation protein, zeta
  ENST ID: ENST00000521607
  CDS Start-End: 12-750
aacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaag

SEQ ID NO: 196726 - DNA, 1394 bp, Homo sapiens
  Payload ID: 18800
  Gene Name: tyrosine 3-monooxygenase/tryptophan 5-monooxygenase activation protein, zeta
  Uniprot ID: P63104
  ENST ID: ENST00000522542
  CDS Start-End: 18-530
gctataatgttaatgtaatgagtcaaccatgcagaaaactctggcgtcacaactatgaaacctcttcctgcattgaattcttgaagtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaaca

SEQ ID NO: 196727 - DNA, 626 bp, Homo sapiens
  Payload ID: 18800
  Gene Name: tyrosine 3-monooxygenase/tryptophan 5-monooxygenase activation protein, zeta
  ENST ID: ENST00000523938
  CDS Start-End: 472-626
ggtcccggatgttgctgaacgggagccccttccagagggagtgactggggcaagcgcagacgggctgagcgaaagctaaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgt

SEQ ID NO: 196728 - DNA, 3983 bp, Homo sapiens
  Payload ID: 18801
  Gene Name: tyrosine aminotransferase
  Uniprot ID: P17735
  ENST ID: ENST00000355962
  CDS Start-End: 135-1499
ggagactatttcaggagttaggatttgcatctgagttcattgcccctgtaacctgtcaaagaagagctaagggagctttcggggttggcttcttggaggctgctttctcctttacttggaaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggggaccctactgtgtttggaaacctgcctacagaccctgaagttacccaggcaatgaaagatgccctggactcgggcaaatataatggctatgccccatccatcggcttcctatccagtcgggaggagattgcttcttattaccactgtcctgaggcacccctagaagctaaggacgtcattctgacaagtggctgcagccaagctattgacctttgtttagctgtgttggccaacccagggcaaaacatcctggttccaagacctggtttctctctctacaagactctggctgagtctatgggaattgaggtcaaactctacaatttgttgccagagaaatcttgggaaattgacctgaaacaactggaatatctaattgatgaaaagacagcttgtctcattgtcaataatccatcaaacccctgtgggtcagtgttcagcaaacgtcatcttcagaagattctggcagtggctgcacggcagtgtgtccccatcttagctgatgagatctatggagacatggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgagatccgagatgggctggtgaagctgagtcagcgcattttgggaccctgtaccattgtccagggagctctgaaaagcatcctatgtcgcaccccgggagagttttaccacaacactctgagcttcctcaagtccaatgctgatctctgttatggggcgttggctgccatccctggactccggccagtccgcccttctggggctatgtacctcatggttggaattgagatggaacatttcccagaatttgagaacgatgtggagttcacggagcggttagttgctgagcagtctgtccactgcctcccagcaacgtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgtttcattacctatgaggtttcatttacttctttgtaaatgtactgacttttggagttacttaagaaccacagttcctaaaacattttatttgggagctcaacttctggcttcctacttaccaagaggcagtaagttataacctctggcctttgtctttacattttcaactttctggatccctaacctctggtcccaagttactacgcttgcctatatccactaaccactcactaggtcacaaagttgatggctctggcttgacccagtgaatgagaagtgtcctagatgtttttttttttttttttttttcgcaaatcttcataggcacagttgcctgtttaattttttcttcagcccttcccttagaggagggagccttaagttacctttcaaggttgggggttaggaatctatcataactagtctagagatttctcaccaagggaaattttccttatctaaaagaggaacttcaggtctcaaccctgccagtcacacccaattaatgtccttcacaaaaataaacagcatatgttccctttcaatttgagttcagtgagctcacagcaaaatttaccttttaattttcttcagcaaatccaagacgaatatacaaaggatgagattagataaagatttcagtttcccgtatgccaccgctgccgccaattttccaaaaaagcctggctcctcttttcctgttcctccatccaagcccccaaagatctctaaccagaaataaacaggaagactcagtgatttacaaaagacattttagttttacacgtacagaaaattctacccagcattacagaattcttagacttcttaaattcctgattttccttggtatttacattttgataagggagccaatggttcttcaaacatttgaaaagaacacatacacactggacaatttcaaacgatacaaacaaacgcaactgtccttctttctcattcctgtccttcagccacccagtttcttctcccctgagggaatcagttatcatttgctggtcatacttccagattatactgtgcctatgtaagtgtgtgtgtgtgtgtgtgtgtgtgcacttttcattttttcaaataaagtattactcaactttgtaa

SEQ ID NO: 196729 - DNA, 1115 bp, Homo sapiens
  Payload ID: 18802
  Gene Name: tyrosine hydroxylase
  ENST ID: ENST00000324155
  CDS Start-End: 20-154
cggacctccacactgagccatgcccacccccgacgccaccacgccacaggccaagggcttccgcagggccgtgtctgagctggacgccaagcaggcagaggccatcatgggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagac

SEQ ID NO: 196730 - DNA, 1889 bp, Homo sapiens
  Payload ID: 18802
  Gene Name: tyrosine hydroxylase
  Uniprot ID: P07101
  ENST ID: ENST00000352909
  CDS Start-End: 92-1585
ggacccagagggggctttgacgtcagctcagcttataagaggctgctgggccagggctgtggagacggagcccggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 196731 - DNA, 1535 bp, Homo sapiens
  Payload ID: 18802
  Gene Name: tyrosine hydroxylase
  Uniprot ID: P07101
  ENST ID: ENST00000333684
  CDS Start-End: 20-1231
cggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctgggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 196732 - DNA, 985 bp, Homo sapiens
  Payload ID: 18802
  Gene Name: tyrosine hydroxylase
  ENST ID: ENST00000381168
  CDS Start-End: 20-166
cggacctccacactgagccatgcccacccccgacgccaccacgccacaggccaagggcttccgcagggccgtgtctgagctggacgccaagcaggcagaggccatcatggtaagagggcagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcagggacctgctgaccactggccccctccccagcggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgt

SEQ ID NO: 196733 - DNA, 1898 bp, Homo sapiens
  Payload ID: 18802
  Gene Name: tyrosine hydroxylase
  Uniprot ID: P07101
  ENST ID: ENST00000381175
  CDS Start-End: 20-1594
cggacctccacactgagccatgcccacccccgacgccaccacgccacaggccaagggcttccgcagggccgtgtctgagctggacgccaagcaggcagaggccatcatgggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 196734 - DNA, 1910 bp, Homo sapiens
  Payload ID: 18802
  Gene Name: tyrosine hydroxylase
  Uniprot ID: P07101
  ENST ID: ENST00000381178
  CDS Start-End: 20-1606
cggacctccacactgagccatgcccacccccgacgccaccacgccacaggccaagggcttccgcagggccgtgtctgagctggacgccaagcaggcagaggccatcatggtaagagggcagggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 196735 - DNA, 483 bp, Homo sapiens
  Payload ID: 18802
  Gene Name: tyrosine hydroxylase
  ENST ID: ENST00000416223
  CDS Start-End: 1-136
ggacttggaccacccgggcttctcggaccaggtgtaccgccagcgcaggaagctgattgctgagatcgccttccagtacaggcacggcgacccgattccccgtgtggagtacaccgccgaggagattgccacctgagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacg

SEQ ID NO: 196736 - DNA, 347 bp, Homo sapiens
  Payload ID: 18802
  Gene Name: tyrosine hydroxylase
  ENST ID: ENST00000412076
  CDS Start-End: 1-347
ggacttggaccacccgggcttctcggaccaggtgtaccgccagcgcaggaagctgattgctgagatcgccttccagtacaggcacggcgacccgattccccgtgtggagtacaccgccgaggagattgccacctgggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacg

SEQ ID NO: 196737 - DNA, 3971 bp, Homo sapiens
  Payload ID: 18803
  Gene Name: tyrosine kinase 2
  Uniprot ID: P29597
  ENST ID: ENST00000264818
  CDS Start-End: 103-3666
agctggggtgggtggaaggttgaagagctaacaggggtctctgggctgagacttgggagctgacagattgtcccctttccagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctgctgg

SEQ ID NO: 196738 - DNA, 4347 bp, Homo sapiens
  Payload ID: 18803
  Gene Name: tyrosine kinase 2
  Uniprot ID: P29597
  ENST ID: ENST00000525621
  CDS Start-End: 483-4046
aaaaaaaaaaaaatccaatggtgacgagcagggagaacagagcagctgccaatgggcgtgtgcgtttcaggcggccaatgggaggaggcgtctcggcgggggacaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 196739 - DNA, 725 bp, Homo sapiens
  Payload ID: 18803
  Gene Name: tyrosine kinase 2
  ENST ID: ENST00000533334
  CDS Start-End: 1-247
gcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaagtagctcaaaactccttgtataggctaggtgtggtggctcacacctatcccagcactttgggaggcagaggtgggaggatcgcttaaacccaggagttcaagaccagcctggatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagag

SEQ ID NO: 196740 - DNA, 3176 bp, Homo sapiens
  Payload ID: 18803
  Gene Name: tyrosine kinase 2
  ENST ID: ENST00000529370
  CDS Start-End: 332-3097
gtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgaggtatgtctaggagacccttgggccctccccgcagtgggggcccctccaagaaatccagaggacagaatcagagctcaaagctgcatcccttctggcctcgtgacttcaagtctctctgggctaccagcaggtgggccactcgctggggctcaatgtagtcccagcctttttaggtccttgtggaagtcacttgtgcctggcacacagaaggcaagtaagagacttgatttcagttttaggcagagtgaccagggcagcgatgggagacgcccaggctgcagagtggggaagaagggctgaggatgcgcctcacccagcagtggggtcagacaaggcttcccaaaggaggttcatgagtgtggtggttttattttgagac

SEQ ID NO: 196741 - DNA, 3456 bp, Homo sapiens
  Payload ID: 18803
  Gene Name: tyrosine kinase 2
  ENST ID: ENST00000524462
  CDS Start-End: 147-3155
agctacccgcgggagcggggaggggtccgggttcgagcttgtgttcccccggaaggggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 196742 - DNA, 495 bp, Homo sapiens
  Payload ID: 18803
  Gene Name: tyrosine kinase 2
  ENST ID: ENST00000525976
  CDS Start-End: 1-194
tcggggtgaccctgtatgagctgctgacgcactgtgactccagccagagcccccccacggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 196743 - DNA, 583 bp, Homo sapiens
  Payload ID: 18803
  Gene Name: tyrosine kinase 2
  ENST ID: ENST00000525220
  CDS Start-End: 1-583
atatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggaggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccg

SEQ ID NO: 196744 - DNA, 842 bp, Homo sapiens
  Payload ID: 18803
  Gene Name: tyrosine kinase 2
  ENST ID: ENST00000529739
  CDS Start-End: 456-842
cacatcatcaagtacaagggctgctgcgaggaccaaggtgggcgggacccggcgagtcctagagacttgagggggcgtggttagagcgtgggtgtggccttgtgggcggggccagtctggcctagccaattagagactctcaaccccaggctgcagtacgcggttcttggcatctgggtgagcgtggctgggctgcctccttcccatctggggggtgctacctgctggggccaggatggacgggagccaccagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacg

SEQ ID NO: 196745 - DNA, 644 bp, Homo sapiens
  Payload ID: 18803
  Gene Name: tyrosine kinase 2
  ENST ID: ENST00000531836
  CDS Start-End: 289-644
aagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcggga

SEQ ID NO: 196746 - DNA, 720 bp, Homo sapiens
  Payload ID: 18803
  Gene Name: tyrosine kinase 2
  ENST ID: ENST00000530829
  CDS Start-End: 317-720
ggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttgtagagacggggtttcaccatgttagccaagatggtcttgatctcctgacctcgtggtctgcccacctcagcctcccaaagtgctgggattataggcgtgagccactgcgcccggccgacaggtatcactcctccttgcttcaatctctttgccctcttcgatgctcaggcccaagtctggttgcccccaaaccacatcctagagatcccca

SEQ ID NO: 196747 - DNA, 558 bp, Homo sapiens
  Payload ID: 18803
  Gene Name: tyrosine kinase 2
  ENST ID: ENST00000530560
  CDS Start-End: 1-429
tcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaacca

SEQ ID NO: 196748 - DNA, 628 bp, Homo sapiens
  Payload ID: 18803
  Gene Name: tyrosine kinase 2
  ENST ID: ENST00000527481
  CDS Start-End: 1-407
atctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaact

SEQ ID NO: 196749 - DNA, 368 bp, Homo sapiens
  Payload ID: 18803
  Gene Name: tyrosine kinase 2
  ENST ID: ENST00000525824
  CDS Start-End: 58-368
ccttcatcatacctcgggtggtgaaggtggcaagagaatttatttccaggcttggaaatgtacccagccctttggccagaaaccagcagtgcaattggctccatcctagctgcaagggaggctgggaaatgtagtcctcctgtgaggccacagcatgggcaacatacgcactgtcctctgcccaggggcaacgtgagactgaagctgcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatc

SEQ ID NO: 196750 - DNA, 3882 bp, Homo sapiens
  Payload ID: 18804
  Gene Name: tyrosine kinase with immunoglobulin-like and EGF-like domains 1
  Uniprot ID: P35590
  ENST ID: ENST00000372476
  CDS Start-End: 80-3496
cacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggctgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 196751 - DNA, 1140 bp, Homo sapiens
  Payload ID: 18804
  Gene Name: tyrosine kinase with immunoglobulin-like and EGF-like domains 1
  Uniprot ID: P35590
  ENST ID: ENST00000538015
  CDS Start-End: 1-1140
atggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcaggctggagggactgggtagatacctccactgagaaacagaacacggatgaggggcgctttggtggtcacgtgtctgcccctgtgggagctccaggatga

SEQ ID NO: 196752 - DNA, 3122 bp, Homo sapiens
  Payload ID: 18805
  Gene Name: tyrosine kinase, non-receptor, 1
  Uniprot ID: Q13470
  ENST ID: ENST00000570896
  CDS Start-End: 447-2432
aacagcttcaactgtagactctgtctaggccagggccaactctccgtaccagcatcaacatctctctgccctggccccattccagggttcattaagtaaagcctgctaggaagctctgaaccccctgccatggggcaggaactgtgtcctatttagccttatattccctgtgcgtggacaggatagctctatcgggcgcttattcatgtaagagggaactcggggtgcggccctcgccggccccgggccagcggccaggtccccgccctccgcgggatttactcctgtcccgcctcctcggatttagcccaggcagcctgggaggttccgcagtcgccgcttccgccttgaccaggtggagctggagacctggtctctctagggcctaccctgagctcaccatctgaaggagagtgccatcatccttaggaactccttctccagacatgcttcctgaggctggctccctgtggctactgaagctgctccgggacatccagttggcccagttttactggcccatccttgaggagcttaatgtcactcggccagagcacttcgactttgtaaagcctgaggacctggacggcattggcatgggccggcctgcccagcgcagactgtccgaagctctgaaaaggctacgttctgggcctaagtctaagaactgggtctacaagatccttggaggttttgcccctgagcacaaggagcccaccctgccctcggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtggctgtcaagtccctccgggtaggtcccgaaggcccgatgggcacagaactgggggacttcctgcgagaggtatcggtcatgatgaacttggagcacccacacgtgctgcgtctgcacggccttgtactgggccagcctctgcagatggtgatggagctggcgccactgggctccctgcacgcgcgcctaacggccccggccccgacacccccgctgctcgtggccctgctctgcctcttcctgcggcagctggcgggagccatggcgtacctgggggcccgcgggctggtgcaccgagacctcgctacgcgcaacctactgctggcgtcgccgcgcaccatcaaggtggctgacttcgggctggtgcggcctctgggcggtgcccggggccgctacgtcatgggcgggccccgccctatcccctacgcctggtgtgccccagagagcctgcgccacggagccttctcgtctgcctcggacgtgtggatgtttggggtgacgctgtgggagatgttctccgggggcgaggaaccctgggccggggtcccaccgtacctcatcctgcagcggctggaggacagagcccggctgcctaggcctcccctctgctccagggccctctactccctcgccttgcgctgctgggccccccaccctgccgaccggcctagcttttcccacctggaggggctgctgcaagaggccgggccttcggaagcatgttgtgtgagggatgtcacagaaccaggcgccctgaggatggagactggtgaccccatcacagtcatcgagggcagccccgactccacaatctggaagggccagaatggtcgcaccttcaaagtgggcagcttcccagcctcggcagtgacgctggcagatgcggggggcttgccagccacccgtccagtccacagaggcacccctgcccggggagatcaacacccaggaagcatagatggagacagaaagaaggcaaatctttgggatgcgcccccagcacggggccagaggaggaacatgcccctggagaggatgaaaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggaggtggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgctatgtcctggccaggccctgagctcagcttctgcgggcacagacaccagcatgaaaagcctaggcccctgagggcctggccacatgggaccaagcggaaccagaacaaggtcccgacaggggtagacgttccacctggggagatcccacctgccgtaggcacatggaggaggagcccagagttgggcactggcaaatgtctcctccctcccatgctccttggcttctgaaggctgaagctcctttggctgggccaagaaggatctagtctgcccactacattctcaaacaagaggacttggaagaaaagagctgctatacatcatatgcagaggaagcttctacgcgctagagaggatcaaggggccacactggaccatgtgaacagccatcctgaactgccatcagctaccacactggactctgcagggcagccatcctggatgatggaagccaccatattgacttggggtataggcccaaactgccttcgtttggtccagggccatcgtgggtgatgacgattgctctcttgcactcaaggacatttgatgctggtagtatggattatgagatggactagcccctgccccagcccagctctcacattcccctttgttttttcccataccaactgcttctaccctcccctattacatacatctttcaatgtccaaaaagttacaaagtttatatgaatgtaacatataaa

SEQ ID NO: 196753 - DNA, 3023 bp, Homo sapiens
  Payload ID: 18805
  Gene Name: tyrosine kinase, non-receptor, 1
  Uniprot ID: Q13470
  ENST ID: ENST00000576812
  CDS Start-End: 370-2370
attcggagaaggctggaaagacgtgaaggaagacgagcagaggagaagggaagggggcttctcacagtcggggcgatctggtctggaggagggaggggccgccagtcgccctggggaccgtcaccttgtcccactagggaactcggggtgcggccctcgccggccccgggccagcggccaggtccccgccctccgcgggatttactcctgtcccgcctcctcggatttagcccaggcagcctgggaggttccgcagtcgccgcttccgccttgaccaggtggagctggagacctggtctctctagggcctaccctgagctcaccatctgaaggagagtgccatcatccttaggaactccttctccagacatgcttcctgaggctggctccctgtggctactgaagctgctccgggacatccagttggcccagttttactggcccatccttgaggagcttaatgtcactcggccagagcacttcgactttgtaaagcctgaggacctggacggcattggcatgggccggcctgcccagcgcagactgtccgaagctctgaaaaggctacgttctgggcctaagtctaagaactgggtctacaagatccttggaggttttgcccctgagcacaaggagcccaccctgccctcggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtggctgtcaagtccctccgggtaggtcccgaaggcccgatgggcacagaactgggggacttcctgcgagaggtatcggtcatgatgaacttggagcacccacacgtgctgcgtctgcacggccttgtactgggccagcctctgcagatggtgatggagctggcgccactgggctccctgcacgcgcgcctaacggccccggccccgacacccccgctgctcgtggccctgctctgcctcttcctgcggcagctggcgggagccatggcgtacctgggggcccgcgggctggtgcaccgagacctcgctacgcgcaacctactgctggcgtcgccgcgcaccatcaaggtggctgacttcgggctggtgcggcctctgggcggtgcccggggccgctacgtcatgggcgggccccgccctatcccctacgcctggtgtgccccagagagcctgcgccacggagccttctcgtctgcctcggacgtgtggatgtttggggtgacgctgtgggagatgttctccgggggcgaggaaccctgggccggggtcccaccgtacctcatcctgcagcggctggaggacagagcccggctgcctaggcctcccctctgctccagggccctctactccctcgccttgcgctgctgggccccccaccctgccgaccggcctagcttttcccacctggaggggctgctgcaagaggccgggccttcggaagcatgttgtgtgagggatgtcacagaaccaggcgccctgaggatggagactggtgaccccatcacagtcatcgagggcagctcctctttccacagccccgactccacaatctggaagggccagaatggtcgcaccttcaaagtgggcagcttcccagcctcggcagtgacgctggcagatgcggggggcttgccagccacccgtccagtccacagaggcacccctgcccggggagatcaacacccaggaagcatagatggagacagaaagaaggcaaatctttgggatgcgcccccagcacggggccagaggaggaacatgcccctggagaggatgaaaggcatttccaggagtctggagtcagttctgtccctcggtcctcgtcccacagggggtggttcaagcccccctgaaattcgacaagccagagctgtgccccagggacctccaggcctgcctccacgcccacctttatcctctagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagattatggaggtggagctgagtgtgcatggggtcacccaccaggagtgccagacagcactaggagccactgggggagatgtggtttctgccatccggaacctcaaggtagatcagctcttccacctgagtagccggtccagagctgactgctggcgcatcctggagcattaccagtgggacctctcagctgccagccgctatgtcctggccaggccctgagctcagcttctgcgggcacagacaccagcatgaaaagcctaggcccctgagggcctggccacatgggaccaagcggaaccagaacaaggtcccgacaggggtagacgttccacctggggagatcccacctgccgtaggcacatggaggaggagcccagagttgggcactggcaaatgtctcctccctcccatgctccttggcttctgaaggctgaagctcctttggctgggccaagaaggatctagtctgcccactacattctcaaacaagaggacttggaagaaaagagctgctatacatcatatgcagaggaagcttctacgcgctagagaggatcaaggggccacactggaccatgtgaacagccatcctgaactgccatcagctaccacactggactctgcagggcagccatcctggatgatggaagccaccatattgacttggggtataggcccaaactgccttcgtttggtccagggccatcgtgggtgatgacgattgctctcttgcactcaaggacatttgatgctggtagtatggattatgagatggactagcccctgccccagcccagctctcacattcccctttgttttttcccataccaactgcttctaccctcccctattacatacatctttcaatgtcc

SEQ ID NO: 196754 - DNA, 253 bp, Homo sapiens
  Payload ID: 18805
  Gene Name: tyrosine kinase, non-receptor, 1
  ENST ID: ENST00000576716
  CDS Start-End: 1-253
acacccaggaagcatagatggagacagaaagaaggcaaatctttgggatgcgcccccagcacggggccagaggaggaacatgcccctggagaggatgaaagctctcctcagcccagccagccctctagggagaggcttccctggcccaaaagaaaacccccacacaatcaccccatgggaatgcctggagcccgtaaagccgctgccctctctggaggcctcttgtccgatcctgagttgcagaggaagatta

SEQ ID NO: 196755 - DNA, 463 bp, Homo sapiens
  Payload ID: 18805
  Gene Name: tyrosine kinase, non-receptor, 1
  ENST ID: ENST00000577009
  CDS Start-End: 1-11
acgcctggtgagagcgggtccgcgggcggtcgggctctgagccgggcggatccggagggcagcagccgagggagatcggagggggccgggcttctgagggaggcttggaccagaagggttatcctcctaggtgtgccccagagagcctgcgccacggagccttctcgtctgcctcggacgtgtggatgtttggggtgacgctgtgggagatgttctccgggggcgaggaaccctgggccggggtcccaccgtacctcatcctgcagcggctggaggacagagcccggctgcctaggcctcccctctgctccagggccctctactccctcgccttgcgctgctgggccccccaccctgccgaccggcctagcttttcccacctggaggggctgctgcaagaggccgggccttcggaagcatgttgtgtgagggatgtcacagaaccaggcgccctgaggatgga

SEQ ID NO: 196756 - DNA, 573 bp, Homo sapiens
  Payload ID: 18805
  Gene Name: tyrosine kinase, non-receptor, 1
  ENST ID: ENST00000576207
  CDS Start-End: 116-349
agtcgccgcttccgccttgaccaggtggagctggagacctggtctctctagggcctaccctgagctcaccatctgaaggagagtgccatcatccttaggaactccttctccagacatgcttcctgaggctggctccctgtggctactgaagctgctccgggacatccagttggcccagttttactggcccatccttgaggagcttaatgtcactcggccagagcacttcgactttgtaaagcctgaggacctggacggcattggcatgggccggcctgccctgattctggcctcccacagcccagcgcagactgtccgaagctctgaaaaggctacgttctgggcctaagtctaagaactgggtctacaagatccttggaggttttgcccctgagcacaaggagcccaccctgccctcggacagcccacggcacctccctgagccagaggggggcctcaagtgtctgatcccagagggtgctgtttgcagaggggagctgctgggttcaggctgcttcggtgtggtgcaccgagggctgtggacgctgcccagtggcaagagtgtcccagtgg

SEQ ID NO: 196757 - DNA, 4552 bp, Homo sapiens
  Payload ID: 18806
  Gene Name: tyrosine kinase, non-receptor, 2
  Uniprot ID: Q07912
  ENST ID: ENST00000333602
  CDS Start-End: 619-3735
gggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgccccgaagccgccccgagctggtggggagggcccggccggtggggccccgggggcctgcgggggaggggcgcctgggggtgcaagaggcgaattggctgcccggggtgcaggagggacaggtggtgcgggctgtccaggaaacctacctgaacgggaaggagccccaggagggagagggacccggcgaggggctcaggacccggaggcgccggcggaggaggaggtggtgactggcaggcccgggccccacggtacctccggggctgaaggggacgcaggatgtaggggcatggggagtcgggcgcagaagagtgcggggaaccgctgagctctgggagccactgcctgagggcaggccgcggccggcgggaacctcttctgccgtctcagcctgggcgtcgctgaagctgtgtctgcggggaggcagcggaaggcggcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 196758 - DNA, 4223 bp, Homo sapiens
  Payload ID: 18806
  Gene Name: tyrosine kinase, non-receptor, 2
  Uniprot ID: Q07912
  ENST ID: ENST00000381916
  CDS Start-End: 146-3406
ggagaggaggaacggagctgggacgggctgcaggagggaatggccgcaggccggcaggaggaggggcgcgaccacccggccgccggccgatggcggatgaggctatgggggctgagacgcagtagcggccctgcacttctggaggatgctcgaggcccggccccccaggacgcagggcagtgacgctgccggtgccgctgcggggcgggggctgcgggcgctgcttctctccctgaccgcagccgctgggatttggggctccatgggggagagatctgcttaccagcgcctggctgggggcgaggagggaccgcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 196759 - DNA, 541 bp, Homo sapiens
  Payload ID: 18806
  Gene Name: tyrosine kinase, non-receptor, 2
  ENST ID: ENST00000427576
  CDS Start-End: 113-541
gagggggtgtacacgtggggtggattctcgaactcctagagggaaggtgccctgagctcagccctaaatacctggtactaaagagtcagtggctgcttcagatgccaccagaatgagaagcggtgccttggggccccgggggagaggaagagcctctgccctgggacttcctgtgccggcgatggcctcgcgccagtgctgggcgcggcacccccgcgtgggcctgtgttgggcggcttttgagcaggagtccgggccctcgtgtcaccgctctgaagtcaaggagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtg

SEQ ID NO: 196760 - DNA, 726 bp, Homo sapiens
  Payload ID: 18806
  Gene Name: tyrosine kinase, non-receptor, 2
  ENST ID: ENST00000424563
  CDS Start-End: 1-726
ggctctgggggctccttccccctgggccaccagccctggcttggaaccacagcacctgccctccgtgcctggagctgctcaggagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgc

SEQ ID NO: 196761 - DNA, 870 bp, Homo sapiens
  Payload ID: 18806
  Gene Name: tyrosine kinase, non-receptor, 2
  ENST ID: ENST00000438207
  CDS Start-End: 1-870
agccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtcc

SEQ ID NO: 196762 - DNA, 4235 bp, Homo sapiens
  Payload ID: 18806
  Gene Name: tyrosine kinase, non-receptor, 2
  ENST ID: ENST00000428187
  CDS Start-End: 297-3419
gttgggtggggaagccggggagtagggctggactgtgaccactgccctggagagaagacagaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtt

SEQ ID NO: 196763 - DNA, 763 bp, Homo sapiens
  Payload ID: 18806
  Gene Name: tyrosine kinase, non-receptor, 2
  ENST ID: ENST00000447060
  CDS Start-End: 210-470
tcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggatgaagggcagccgactccctggtgagggtggagacagacagcaccaaatggtcaggccagagaaggggccagggctaaaaatggacaaggaggtgtctgtggagggcccctgcggctccatcgatgcgggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgc

SEQ ID NO: 196764 - DNA, 580 bp, Homo sapiens
  Payload ID: 18806
  Gene Name: tyrosine kinase, non-receptor, 2
  ENST ID: ENST00000433111
  CDS Start-End: 288-580
gtcgggctgttttcctgggcgaggagaaagggggccgggccgggccgggcgcggtggctcacgcctgtcatctcagcactttgggaggccgaggcgggcagatcacctgagacgaggacgctgagctggattactgggccagttacaggtcttgttcttactggacatccaagcatcccggagttccttcccgtcctcccacatgcatcccctgtgcagagctgcgctgttgctgggtcagggagcatggagtgcacagctgaacagagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcacctt

SEQ ID NO: 196765 - DNA, 2331 bp, Homo sapiens
  Payload ID: 18806
  Gene Name: tyrosine kinase, non-receptor, 2
  Uniprot ID: Q07912
  ENST ID: ENST00000439230
  CDS Start-End: 58-1644
cgcggagccggctgagcgcagggccgagctgcggggcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagtgtcctttctctgccttctctccaggacaccccccagctgagacgtgcggtcaggttctgtggactgggaggcgggaggcctgtgcttcagacccaagactacacccggtttcctccaggacgaaggggctctgatgagattctgccacccctccacacgcttcccctgctctcttgacccagctctctcccccacagactgtatctgggaaaccccatggacccccccgacctcctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggc

SEQ ID NO: 196766 - DNA, 2641 bp, Homo sapiens
  Payload ID: 18806
  Gene Name: tyrosine kinase, non-receptor, 2
  ENST ID: ENST00000416152
  CDS Start-End: 1-1824
ctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaagggagcctccacctcgcccacctcagcctgccttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctacccccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatgctgcaggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgtta

SEQ ID NO: 196767 - DNA, 829 bp, Homo sapiens
  Payload ID: 18806
  Gene Name: tyrosine kinase, non-receptor, 2
  ENST ID: ENST00000430929
  CDS Start-End: 1-432
gtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggcatcagtttcccaaattgcctcgagggagaggcctgagaaactgcaggactcctagaggtccccagacagcaggccaggaaggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacgg

SEQ ID NO: 196768 - DNA, 600 bp, Homo sapiens
  Payload ID: 18806
  Gene Name: tyrosine kinase, non-receptor, 2
  ENST ID: ENST00000411741
  CDS Start-End: 1-600
gttggccccagccgctggttccctgtggctgctgctggtggggctctgggggctccttccccctgggccaccagccctggcttggaaccacagcacctgccctccgtgcctggagctgctcaggagtccctgaatatctccatgtttgtttggctgcctccgtctccatgtctccaggcggatggctctgtggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtg

SEQ ID NO: 196769 - DNA, 4639 bp, Homo sapiens
  Payload ID: 18807
  Gene Name: Tyrosine-protein kinase SgK223  [Source:UniProtKB/Swiss-Prot
  Acc:Q86YV5]
  Uniprot ID: Q86YV5
  ENST ID: ENST00000622241
  CDS Start-End: 1-4221
atgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtcatctggagacgagcccctggcaagctccccctcccgaagcaggaggatgcccccgtcgtctacctgggcagcttccgaggtgtacagaagcctgctggtccctctacctcccctgatggcaattctcgctgtcccccagcttacaccatggtcggcctgcacaaccttgagccccgcggcgagaggaacattgccttccacccggtgagcttcccggaggagaaggctgtgcacaaagaaaaaccctcatttccttaccaagaccggccctccacccaggagagcttccgccagaaactggctgcctttgctgggaccacatctggctgtcaccagggccctgggcccctgcgggaatccctgccctcggaggatgacagtgatcaaaggtgctcgccctccggggacagcgagggtggagagtactgctccatcctggactgctgccctgggagccctgttgccaaggctgcctcccagactgcaggttcccggggcaggcatggtggcagggactgctcacccacgtgctgggagcaggggaagtgttccgggcccgcagagcaggagaagcggggcccgagcttccccaaggagtgctgtagccagggccccactgcccacccatcctgcctgggccccaagaaactgtccctcacctcggaggctgccatttcttccgacggcctctcttgtggcagcggcagcggcagcggcagcggcgccagtagccccttcgtcccccacctcgagagtgattactgctccctcatgaaggaacctgccccagagaagcagcaggaccctggctgcccaggggtgacccctagcagatgccttgggctgacgggggagccccagcccccggcccacccccgggaggctacacagcctgaacccatctatgctgagagcaccaagaggaagaaggcagctccggtgccttccaagtcacaggccaagatagaacatgcagctgctgcccagggccaaggccaggtatgcacaggtaatgcctgggcccagaaagcagcatctggctggggccgggacagcccagacccaactccccaggtgtcagccaccatcacagtcatggcggcccacccggaagaggaccatcggacgatctacctgagcagccctgactctgcagtgggggtgcagtggccacgagggcctgtgagccagaactccgaggtaggtgaagaggagacttcggctgggcaggggctgagctccagggaaagccatgctcacagtgccagcgagagcaagcccaaggagaggcccgccattccccccaagttgtccaagagtagccctgtagggtccccggtgtcaccgtctgctggagggcccccagtgtcaccgctggctgaccttagtgatgggagctctggcggcagcagcattgggccccagcctccatcccaaggtcctgctgaccccgctccttcctgccggaccaacggtgtcgctatcagtgacccatccaggtgtccccagcctgccgcctcgtcagcctcggaacagaggcggcccaggttccaggcaggcacctggagtcgtcagtgccggatagaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgggatgagcaaatccgcctcttttgcctttgagttccccaaggacagaagtgggattgagacattctcacctcctcctccgcctccaaagtcgcggcaccttctaaaaatgaacaagagcagctctgatttggaaaaagtgagccagggctctgcagaaagcctcagcccatccttcaggggtgtccacgtcagcttcaccaccggctccacggacagcctggcctcagactctaggacctgcagcgatggaggtccctcgtctgagctggctcactcgcccaccaacagcgggaagaagctctttgctcccgttccgtttccttcaggctccactgaggacgtgtcccccagtggcccccagcagccccctccactcccccagaaaaagatagtgagccgggcagcctcttcaccggatggcttcttctggacccaaggctcccccaagcccggaacagcaagccccaagctgaacctaagccactcggaaaccaacgtccacgacgaatctcactttagctattcgttgagccccgggaaccgccaccatcctgtcttctcctcttccgatcctctggagaaagctttcaaaggcagtggccactggcttccggcagcagggctggcgggcaacagaggcggctgcgggagccctggcctccagtgcaaaggggccccctccgcctcatcctcccagctgagcgtgtccagtcaagcctccaccgggagcacccagcttcagctgcacggtctcctgagcaacatcagcagcaaggagggcacctatgccaagctggggggactctacacccagtccctggcccgccttgtagccaaatgtgaggacctcttcatgggcggccagaaaaaggagctccacttcaatgagaataactggtcgctcttcaagctgacttgtaacaagccctgctgtgactcgggggatgccatttattactgtgccacctgctctgaggaccccggcagcacctatgctgtgaaaatctgcaaagcccctgagcccaaaacagtctcctactgcagcccgtccgtgcccgtgcactttaacatccagcaggactgcggccacttcgtcgcctcggtgccgtccagcatgctcagctcccccgacgcgcccaaggaccctgtgcctgccctgcccacacacccccctgcccaggagcaggactgcgtggtggtcatcacccgagaggtgccacatcagaccgcctccgacttcgtgcgggactcggcggccagccaccaggcggagcccgaggcgtacgagcggcgcgtgtgcttcctgcttctgcaactctgcaacgggctggagcacctgaaggagcacgggatcatccaccgggacctgtgcctggagaacctgctgctggtgcactgcaccctccaggccggccccgggcccgcccccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatga

SEQ ID NO: 196770 - DNA, 4903 bp, Homo sapiens
  Payload ID: 18807
  Gene Name: Tyrosine-protein kinase SgK223  [Source:UniProtKB/Swiss-Prot
  Acc:Q86YV5]
  Uniprot ID: Q86YV5
  ENST ID: ENST00000615670
  CDS Start-End: 266-4486
ccggaggcggagggggcggagccgcgctcacagctgccacccggccgccgggcccaggcagaagccacccgcccgcggccgggcacgcaccgcgcgcagaccttctgcgaacaatgctccggccgggcggctggcggctcggagaccgacggaggggccgggggagcgcagcccagaggaagccgctctgtgacccacctctgaatcccacaaaactgcaccagagagccgggcgcaagatgaaccagcaccctgtcggctcaagatgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtcatctggagacgagcccctggcaagctccccctcccgaagcaggaggatgcccccgtcgtctacctgggcagcttccgaggtgtacagaagcctgctggtccctctacctcccctgatggcaattctcgctgtcccccagcttacaccatggtcggcctgcacaaccttgagccccgcggcgagaggaacattgccttccacccggtgagcttcccggaggagaaggctgtgcacaaagaaaaaccctcatttccttaccaagaccggccctccacccaggagagcttccgccagaaactggctgcctttgctgggaccacatctggctgtcaccagggccctgggcccctgcgggaatccctgccctcggaggatgacagtgatcaaaggtgctcgccctccggggacagcgagggtggagagtactgctccatcctggactgctgccctgggagccctgttgccaaggctgcctcccagactgcaggttcccggggcaggcatggtggcagggactgctcacccacgtgctgggagcaggggaagtgttccgggcccgcagagcaggagaagcggggcccgagcttccccaaggagtgctgtagccagggccccactgcccacccatcctgcctgggccccaagaaactgtccctcacctcggaggctgccatttcttccgacggcctctcttgtggcagcggcagcggcagcggcagcggcgccagtagccccttcgtcccccacctcgagagtgattactgctccctcatgaaggaacctgccccagagaagcagcaggaccctggctgcccaggggtgacccctagcagatgccttgggctgacgggggagccccagcccccggcccacccccgggaggctacacagcctgaacccatctatgctgagagcaccaagaggaagaaggcagctccggtgccttccaagtcacaggccaagatagaacatgcagctgctgcccagggccaaggccaggtatgcacaggtaatgcctgggcccagaaagcagcatctggctggggccgggacagcccagacccaactccccaggtgtcagccaccatcacagtcatggcggcccacccggaagaggaccatcggacgatctacctgagcagccctgactctgcagtgggggtgcagtggccacgagggcctgtgagccagaactccgaggtaggtgaagaggagacttcggctgggcaggggctgagctccagggaaagccatgctcacagtgccagcgagagcaagcccaaggagaggcccgccattccccccaagttgtccaagagtagccctgtagggtccccggtgtcaccgtctgctggagggcccccagtgtcaccgctggctgaccttagtgatgggagctctggcggcagcagcattgggccccagcctccatcccaaggtcctgctgaccccgctccttcctgccggaccaacggtgtcgctatcagtgacccatccaggtgtccccagcctgccgcctcgtcagcctcggaacagaggcggcccaggttccaggcaggcacctggagtcgtcagtgccggatagaggaagaagaggaggtggagcaggaattgctgagtcacagctggggaagagagaccaaaaatggccccacggaccattcaaactccacgacctggcaccgtctccaccccacagatggctcctctgggcagaacagcaaagttgggaccgggatgagcaaatccgcctcttttgcctttgagttccccaaggacagaagtgggattgagacattctcacctcctcctccgcctccaaagtcgcggcaccttctaaaaatgaacaagagcagctctgatttggaaaaagtgagccagggctctgcagaaagcctcagcccatccttcaggggtgtccacgtcagcttcaccaccggctccacggacagcctggcctcagactctaggacctgcagcgatggaggtccctcgtctgagctggctcactcgcccaccaacagcgggaagaagctctttgctcccgttccgtttccttcaggctccactgaggacgtgtcccccagtggcccccagcagccccctccactcccccagaaaaagatagtgagccgggcagcctcttcaccggatggcttcttctggacccaaggctcccccaagcccggaacagcaagccccaagctgaacctaagccactcggaaaccaacgtccacgacgaatctcactttagctattcgttgagccccgggaaccgccaccatcctgtcttctcctcttccgatcctctggagaaagctttcaaaggcagtggccactggcttccggcagcagggctggcgggcaacagaggcggctgcgggagccctggcctccagtgcaaaggggccccctccgcctcatcctcccagctgagcgtgtccagtcaagcctccaccgggagcacccagcttcagctgcacggtctcctgagcaacatcagcagcaaggagggcacctatgccaagctggggggactctacacccagtccctggcccgccttgtagccaaatgtgaggacctcttcatgggcggccagaaaaaggagctccacttcaatgagaataactggtcgctcttcaagctgacttgtaacaagccctgctgtgactcgggggatgccatttattactgtgccacctgctctgaggaccccggcagcacctatgctgtgaaaatctgcaaagcccctgagcccaaaacagtctcctactgcagcccgtccgtgcccgtgcactttaacatccagcaggactgcggccacttcgtcgcctcggtgccgtccagcatgctcagctcccccgacgcgcccaaggaccctgtgcctgccctgcccacacacccccctgcccaggagcaggactgcgtggtggtcatcacccgagaggtgccacatcagaccgcctccgacttcgtgcgggactcggcggccagccaccaggcggagcccgaggcgtacgagcggcgcgtgtgcttcctgcttctgcaactctgcaacgggctggagcacctgaaggagcacgggatcatccaccgggacctgtgcctggagaacctgctgctggtgcactgcaccctccaggccggccccgggcccgcccccgcccccgccccggctcccgcccccgccgccgccgcgcctccctgctcctctgccgccccgcctgctggtggcactctcagccccgcagccggccccgcctccccggaagggccccgggagaagcagctgccccggctcatcatcagcaactttttgaaggccaagcagaagccgggcggcaccccaaacctgcagcagaagaagagccaggcccggctggcccccgagatcgtgtctgcttcccagtaccgcaagttcgatgagttccagacaggcatcctcatctacgagctgctgcaccaacccaacccgttcgaggtgcgcgcccagctgcgggagagagactaccggcaggaggacctgccgccgctgcccgcgctgtccctctactcacccggcctgcagcagctggcacatctgctactggaggccgaccccatcaagcgtatccgcatcggcgaggccaagcgcgtgctgcagtgcctgctgtgggggcctcggcgcgagctggtgcagcagccgggcacctcggaggaggcgctgtgcggcacgctgcacaactggatcgacatgaagcgggccctgatgatgatgaagtttgcggagaaggcggtggatcgcaggcggggcgtggagctggaggactggctttgctgccagtacctggcgtctgcggagcccggggccctcttacagtcgctgaagctcctgcagcttctgtgagccaagccccagcctgcaccgtcgctgccccttccctgcctaaccctttcctgtctcgccttggaagcacccatgtctccctgggaaatggtacagatgactgggatacctggatgtaaaatatataaatatatatatagaaaatacatataccatatataaatatgaaagactaaggatgctgttgcccgtccacactcgtctcctctctgcactaagtcctccctgttttcttctgtaattatacacatttccagttccatgcaacgtcctgaggacagttctgtgaactgaatgcagcctggacactggcctcaataccttgtttaggatttcttcacccttttgtcaaattgttatttaaagaaaaaaaaaaaagaagaaaattccattaaaattttttttggttgagtcatg

SEQ ID NO: 196771 - DNA, 3702 bp, Homo sapiens
  Payload ID: 18808
  Gene Name: tyrosyl-DNA phosphodiesterase 1
  Uniprot ID: Q9NUW8
  ENST ID: ENST00000335725
  CDS Start-End: 251-2077
gttggttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattcacttttatatgttttggaaagaaaattagtgaacttctctatgttaaaaatacgtactgcttgagtatcccctgtctgaaatgcttgggaccagaagtgtttcagcttttggatttttttgaattttggaatatttgcatagcataatgagatatcttgggaatgggacccaaatctaaacacaaaattcatttatgtttcatatacaccttatatacaataacctaaaggtgattttatatgatattttgagtaattttatgcatgaaacaaagttttgacaggcttttgaccgtgattcatcacatgagttcaggcatggaaattttcatttggagcatcatgtcagcactcaaaaagttctggatcttggagcagttcagattttcagattagggatgctcaaatctatatagatataaaattatcctcacagtaacatagaatctcttggtgctgtcagctgttgggaattgaagattgactttgtgcttccaccctccatccagaaaggcacccttcattccaccagaactttacccaggaagaacacgatcatttcctttttcaccgatgccctctctcagctttctgagtacgtctcttggggtcgctggaggtgatcctaggatctgtctctgagaccaatgtgctgtttcagccccctgcagctaagaattgtattgactgtcctcacagcggcttttcatagctttcagcttcagctttacgaggcttctcctctctccctggcaccctgctggctgcctcactgcttacagacaggtcccaccaaacccaaacacctgcctagggtaaatgggtctctcttctatccccagaaactttcagaggaagcagctcatagaaacatacaaaagcacacaagtattttgggaaaaaatcctaaaaggtgacttaatttgatgccttaaattcacaagtgaggaagctaaggcctagaaggttaaggatgtccccagggtcacacagtgagcggggctcagagcttgagtgtctttgtgctttgtgtacattgtgttctccctagggtgctttagaccctgtttgttttcttctgcatgaggctgatttccagtttgtcatcaacctctttatcttataatttaggatagagttgaacgttagtcttgaaagattttctaaagtagtctttcaaactgttcctcagaggcctaggattttccaaaagtaccttaggaaccttgtaggctgcagtgggggtgtggcgatagagcaggaggcagggagacagggctgcagggcctcccaccttccaacagacaggctctgctgtatctgttgtacatactgggattctgtaaaggacattatctggggtgttgtatgtatttttgtgtgttctgctttttttaaataaacttgaaaagctactgaactaa

SEQ ID NO: 196772 - DNA, 2370 bp, Homo sapiens
  Payload ID: 18808
  Gene Name: tyrosyl-DNA phosphodiesterase 1
  ENST ID: ENST00000393452
  CDS Start-End: 300-2069
actgcgcgcatgcgcggcggccgccgaaggggcgggatccgaggcaagcgttggttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttgcccctgcgaagagaataaaggatgaagtggaggcttcgttctctgggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 196773 - DNA, 2068 bp, Homo sapiens
  Payload ID: 18808
  Gene Name: tyrosyl-DNA phosphodiesterase 1
  Uniprot ID: Q9NUW8
  ENST ID: ENST00000393454
  CDS Start-End: 41-1867
atccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaattc

SEQ ID NO: 196774 - DNA, 2488 bp, Homo sapiens
  Payload ID: 18808
  Gene Name: tyrosyl-DNA phosphodiesterase 1
  ENST ID: ENST00000545686
  CDS Start-End: 244-1140
ccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaactcacctgtgagtgaatctctgatccaggaggagcctcactcagcctgggaactttgaggtgctattgcaaggggaggtcctccacgtctgtccagcccaacctggtcattttacacacggaggcaaaggcccagagagatcacagagcttacccaaaatgaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagctttgcataattatcaaagcaggaaatgcagatcagtcttctgcagtgttttagctgcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaacattcctaataaagtattagtttcttaa

SEQ ID NO: 196775 - DNA, 1894 bp, Homo sapiens
  Payload ID: 18808
  Gene Name: tyrosyl-DNA phosphodiesterase 1
  ENST ID: ENST00000555880
  CDS Start-End: 11-1747
caggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggaca

SEQ ID NO: 196776 - DNA, 876 bp, Homo sapiens
  Payload ID: 18808
  Gene Name: tyrosyl-DNA phosphodiesterase 1
  ENST ID: ENST00000553617
  CDS Start-End: 218-876
cgaggcaagcgttggttctgtgcgcctcaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattt

SEQ ID NO: 196777 - DNA, 1076 bp, Homo sapiens
  Payload ID: 18808
  Gene Name: tyrosyl-DNA phosphodiesterase 1
  ENST ID: ENST00000556063
  CDS Start-End: 1-844
acgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaaggtgagacacagataaaggaaaaccacgggtggatatgcataagaaaaacaaacagagcccaggagaagcctttggtctcagtgggatcctggctcatggaaccctctggaagctcaagtttgcagagggccctttgccagcctgtctggggccttgtagccactggttagtcttggaatccctttgcactcctataattactatacagatccttcctgacttacactggggctacatgctgataaacccctcatgaattgaaaatatcataagtcaaaaatgcatttaatgcgtcaaatctactgagcaccatagcttagtctagcctaccctaaacatgatcagacctcttaaattagtctacacttgggcaaaataaatcaaagactgttttataataaa

SEQ ID NO: 196778 - DNA, 910 bp, Homo sapiens
  Payload ID: 18808
  Gene Name: tyrosyl-DNA phosphodiesterase 1
  ENST ID: ENST00000554180
  CDS Start-End: 72-910
gcgcatgcgcggcggccgccgaaggggcgggatccgaggcaagcgttggttctgtgcgcctcaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcataca

SEQ ID NO: 196779 - DNA, 910 bp, Homo sapiens
  Payload ID: 18808
  Gene Name: tyrosyl-DNA phosphodiesterase 1
  ENST ID: ENST00000553527
  CDS Start-End: 473-910
atcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgag

SEQ ID NO: 196780 - DNA, 318 bp, Homo sapiens
  Payload ID: 18808
  Gene Name: tyrosyl-DNA phosphodiesterase 1
  ENST ID: ENST00000557782
  CDS Start-End: 1-156
gcaaagttggatattgcgtttggaacacaccacacgaaaatgatgctgctgctctatgaagaaggcctccgggttgtcatacacacctccaacctcatccatgctgactggcaccagaaaactcaaggccattttgtacatctctgcctgtgctagagaagagctggttaacaaacagccttctgtgttgggagaaactcggacgtttgtctagcaccatttccagaactcacctgtgagtgaatctctgatccaggaggagcctcactcagcctgggaactttgaggtgctattgcaaggggaggtcctccacgtct

SEQ ID NO: 196781 - DNA, 3040 bp, Homo sapiens
  Payload ID: 18808
  Gene Name: tyrosyl-DNA phosphodiesterase 1
  ENST ID: ENST00000554976
  CDS Start-End: 970-1545
cttaactcgttgagcgcggctggaaatccaagcgcttctaggtgctggttcaatgcctggttcatgatttatttcattctctccctccatcttgcaataggttacttttaatcatttagatctatgacactatgctaaacgttataggagacaaaaagactgtgaacaaacaagaagaaccaaacgaaaagagccaagtccaggattctcgttcagatcagcaagtcattgggatcgagctcctagggcagctactacatctgttatgtcctcaagataatcccagcacctagcactgtgcctggcacaaagtagatcttcaatgaaagaacgaaacgagccgttatatttacacagatgtatttcactcagtcctctggaagagatgcctagtgtgaaagagattccaagaataaataccataaacagcaccgagcccaaatcccacagcaaacatccttattaaaggcaaggaacgtggggcgagttccttttctcagaagattttacgagaacgcaactgttgcgaagaaggaacagacattcgaggttctgagtccaatgggaactcatttaactttttattttgcagcagatttcaaagtctgcacccagcccctcccaggacacaggtctccttgcagctgcctttaacctaagcgtatcctctctccactttaaaccaaacgccgctgcatggagccctgggagcctgagccatgagaatcctgtaaagaggagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaagggacagtcttatgagtagatgttacaatcgtattccttggataaatgatgcatctgcactttagaaaagtgcccaaggtcgtagagctgatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggcaaagttggatattgcgtttggaacacaccacacgaaaatgatgctgctgctctatgaagaaggcctccgggttgtcatacacacctccaacctcatccatgctgactggcaccagaaaactcaagggttcgtaggggcctgctcacttcctggcagtgtgtgtgttgataaagaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttac

SEQ ID NO: 196782 - DNA, 597 bp, Homo sapiens
  Payload ID: 18808
  Gene Name: tyrosyl-DNA phosphodiesterase 1
  ENST ID: ENST00000556498
  CDS Start-End: 113-597
gggttatagctctatttgcactcgctgtttagctggtccgaatttcttgtcctgcgtccaagaataatgaggttaggctgacaaccgaaggggaaaagggcggaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaa

SEQ ID NO: 196783 - DNA, 748 bp, Homo sapiens
  Payload ID: 18808
  Gene Name: tyrosyl-DNA phosphodiesterase 1
  ENST ID: ENST00000556867
  CDS Start-End: 294-748
cgcggactcggtgcggtctctcgcgggctgcggtcgggcccgggatcctgctcctggccgagtcgcggtgcgcgggctgctggggtccggcagggctggaggcggaccgcgaggaagcggcgcggccgggaagatggggcagggtcgcctcggccccggggcctcggtttcctccgatcacagcgcctcagggggcgcgcacgggcgctgcggagacctgtgtcctgccggggcgcggcgctaggggcccctgctcgggtttttattcccagacctaagcttacaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggcca

SEQ ID NO: 196784 - DNA, 728 bp, Homo sapiens
  Payload ID: 18808
  Gene Name: tyrosyl-DNA phosphodiesterase 1
  ENST ID: ENST00000553989
  CDS Start-End: 286-728
aacgccttcagcaagagccctctcacttcctttgtcttcaacccattctccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatc

SEQ ID NO: 196785 - DNA, 2200 bp, Homo sapiens
  Payload ID: 18808
  Gene Name: tyrosyl-DNA phosphodiesterase 1
  ENST ID: ENST00000555178
  CDS Start-End: 237-1016
ccgcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatggtggatgcctgtaatcctagctcctcgggaggctaaggagtataatgtctcaggaaggcgattatgggaggtggaccatatctagtagtgatgaaagtgaggaagaaaagccaaaaccagacaagccatctacctcttctcttctctgtgccaggcaaggagcagcaaatgagcccaggtacacctgttccgaggcccagaaagctgcacacaagaggaaaatatcacctgtgaaattcagcaatacagattcagttttacctcccaaaaggcagaaaagcggttcccaggaggacctcggctggtgtctgtccagcagtgatgatgagctgcaaccagaaatgccgcagaagcaggctgagaaagtggtgatcaaaaaggagaaagacatctctgctcccaatgacggcactgcccaaagaactgaaaatcatggcgctcccgcctgccacaggctcaaagaggaggaagacgagtatgagacatcaggggagggccaggacatttgggacatgctggataaagggaaccccttccagttttacctcactagagtctctggagttaagccaaagtataactctggagccctccacatcaaggatattttatctcctttatttgggacgcttgtttcttcagctcagtttaactactgctttgacgtggactggctcgtaaaacagtatccaccagagttcaggaagaagccaatcctgcttgtgcatggtgataagcgagaggctaaggctcacctccatgcccaggccaagccttacgagaacatctctctctgccaggaaaatgatgctgctgctctatgaagaaggcctccgggttgtcatacacacctccaacctcatccatgctgactggcaccagaaaactcaaggaatatggttgagccccttatacccacgaattgctgatggaacccacaaatctggagagtcgccaacacattttaaagctgatctcatcagttacttgatggcttataatgccccttctctcaaggagtggatagatgtcattcacaagcacgatctctctgaaacaaatgtttatcttattggttcaaccccaggacgctttcaaggaagtcaaaaagataattggggacattttagacttaagaagcttctgaaagaccatgcctcatccatgcctaacgcagagtcctggcctgtcgtaggtcagttttcaagcgttggctccttgggagccgatgaatcaaagtggttatgttctgagtttaaagagagcatgctgacactggggaaggaaagcaagactccaggaaaaagctctgttcctctttacttgatctatccttctgtggaaaatgtgcggaccagtttagaaggatatcctgctgggggctctcttccctatagcatccagacagctgaaaaacagaattggctgcattcctattttcacaaatggtcagctgagacttctggccgcagcaatgccatgccacatattaagacatatatgaggccttctccagacttcagtaaaattgcttggttccttgtcacaagcgcaaatctgtccaaggctgcctggggagcattggagaagaatggcacccagctgatgatccgctcctacgagctcggggtccttttcctcccttcagcatttggtctagacagtttcaaagtgaaacagaagttcttcgctggcagccaggagccaatggccacctttcctgtgccatatgatttgcctccagaactgtatggaagtaaagatcggccatggatatggaacattccttatgtcaaagcaccggatacgcatgggaacatgtgggtgccctcctgagaatcttgaggcactgtgaaatttaagtgtaagacattgagccacaaacatggaatctcttctttgtactggatgtccacttcccttaaagtcttatttgcacccttacaaaatctttccaaaggtcactcttatgaatggatgttggttatacttttaatggacattaaca

SEQ ID NO: 196786 - DNA, 2120 bp, Homo sapiens
  Payload ID: 18809
  Gene Name: tyrosyl-DNA phosphodiesterase 2
  ENST ID: ENST00000341060
  CDS Start-End: 397-1311
cgagcctccggtggaggagagcgccttggaacgccgacctgaaaccatctctgagcccaagacctagtaagtgatgaggggagcgggagccagtccgcacggaggcagtttgataccaggtagccctgcgcgtcctgggacctgccgtggagctgggcggacgatgctgaggcagatctccaagctgcgtagccagaggagcagggcttgcgttgctgctgctgcgcggagttgcgccccagcagcggatctaacactgcaccagactgtcgcttcgaacgtgatttggggtccagggaggaaaagatggaaatgtaatgtttaactcaaatgaaaggaaataagtaagcgagaggtttgaaacaaatgaacgaaggctaaaccttctatcgaaaaatggcaacttggaagtctccttgcttcctgtattgtttatttattctaggccctaggctgaccggccagaataacagtgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgtt

SEQ ID NO: 196787 - DNA, 2071 bp, Homo sapiens
  Payload ID: 18809
  Gene Name: tyrosyl-DNA phosphodiesterase 2
  Uniprot ID: O95551
  ENST ID: ENST00000378198
  CDS Start-End: 172-1260
gcacccaccgccccggcggctcccttgcggcgcagctgcaccagttttccgagagcagcgcatttccccgccgggcggttgatgcgggagcgccatgacacaggcgcctgcgcagagccgcgcgttggcctcctgttccgcttaaaggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctacctaaagaagagatcaagtaattatgagattattacaggtcatgaagaaggatatttcacagctataatgttgaagaaatcaagagtgaaattaaaaagccaagagattattccttttccaagtaccaaaatgatgagaaaccttttatgtgtgcatgtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgttta

SEQ ID NO: 196788 - DNA, 2116 bp, Homo sapiens
  Payload ID: 18810
  Gene Name: tyrosylprotein sulfotransferase 1
  Uniprot ID: O60507
  ENST ID: ENST00000304842
  CDS Start-End: 426-1538
tccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagca

SEQ ID NO: 196789 - DNA, 562 bp, Homo sapiens
  Payload ID: 18810
  Gene Name: tyrosylprotein sulfotransferase 1
  ENST ID: ENST00000451388
  CDS Start-End: 141-562
attacagtgtaagtgagagctggctgcagatgaagcaggatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagcctt

SEQ ID NO: 196790 - DNA, 560 bp, Homo sapiens
  Payload ID: 18810
  Gene Name: tyrosylprotein sulfotransferase 1
  ENST ID: ENST00000442120
  CDS Start-End: 436-560
gagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagccctgggaccacgtcctagccccgcagtcccctgggatgagaccctcgtctcgccgggatcggacatttgcccccacgtctaccccggctgcgcttcttgagctcatcgccccatcatcctacccgttatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagt

SEQ ID NO: 196791 - DNA, 5697 bp, Homo sapiens
  Payload ID: 18811
  Gene Name: tyrosylprotein sulfotransferase 2
  Uniprot ID: O60704
  ENST ID: ENST00000338754
  CDS Start-End: 272-1405
acgtcgccgcggccccgcccccgcgcgggcacctcccccttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatgaatagggttttttttttctttccatactggattttgtcaggtagatttgtgatgagcaaaaagctggagaatataggtgcatgtaaggcacagctgaattcctgtgtcagggtccccagggccacccccaggatcgatgattggctagaagaactcagaattcagaagagctattatccttatggttatggtttattacagcaaaaggataaacattaaaatcagcaaaagaggccgggtggagtggctcacgcctgtaatcccagcactttgggaggccaaggcaggcagatcgcctgaggtcaggagttcgagaccagcctggccaacatggtgaaaccccgtctctactaaaaatacaaaaattacctgggcgtggtggtgtgcacctgtaatcccagctactcaggaggcttgaacctgggaggcggaggttgcagtgagcggagatcgtgccattatactccagcctgggtgacagagcaagactccatctcaaaataaaatcaacaaaagaaaaaggtgcatagggcagagtccgggagagaccggcctcaagcttccagttgtcatctcctggtagagtcttacagacacacttaattttcccagcaatgatatgtgacaacacgtactaaatattaccagccagaaagctcaccctagccttggggtctaggtttttattgcatgtcagtcacatagggcaatcacatgaccgactttagttacttaatcaccagctgctccagaggtcaaaatgatacagcatggcccaaggtccccaccataaatcacattattagcacaaactatctggcctggtatggcccaaggcctgaggtatacaaagacacccctacttgggaggatattccaaggacttagaggttatctcccaggagcccattaaggccagttttttctttgagatgtgctgggtttggacacttcaagcctgctgagttaacccttatagcacagtccccaaatgctgagggaccaactgggcctacaataagtttgtatctttaagggttaaggtgttttacccatacctccttgccttatatctcatgataatatgaggcttttggaaggcagtgacttattgtggcttggggcatgggtttttggagtcaggctgacctactggctgtatggcttgagactttgtctcttcatctgtaaaatggggaagttaaaacttcatggtgtgtatgtgtgtatgtgtgtgtttagacagaatctcgctctgtcactcaggctagagtacagtggcgtgatcatagctcactgcagcctcggtctcctagggtcaggtgatcctcccatcttagcctcctgagtagctgggcatgtgccaccacacctggctactttttaaatttttttttttctgtagagacgaggtctttctatgctgttcaggctgaacttcatgggtttattggggatggctaatggatgacattggcggtggtccttgataccagataagccctcagtgtgaagcagctcttatttttccttgtcttgagattgctctggaatggaaattaggcttttttgaaggtgtgaccctttttgttcatttcttcagcagttactttttattttttaaatgtttgacacacagtctctgataaatgatcattcaccaatcaccgattactctccttgctctgttaagtgtgacactgtccctttgagaatctggcgacagctatgtatcccatcaccacacaccccaaaaaaaaaatttatgtctggttccaggagttaccttttatgagaagtccatctgtgaagaccctggatgttcagagaacttcctgggaaaacactgaaagaaaataaagaggccgggcccggtggctcatgcttgtaatcccagcactttgggaggctgaggtgggcagataagctgaggtcaggagttccagaccagcctggccaacgtggcgaaaccccatctactaaaaatacaaaaattagctgggcgtcgtggcgcatgcctgtagttgcagctacttgggaggctgaggcaggagaattgcttgaacccaggaggcagaggttgcagtgaaccaagatcatgctagtacactccagcctgggcaacagagtgagactccatctcaaaaataaaataaataaaacaaaataaaataaatacaatttctgtttctagcccctaagtggtagcactgggtcttgttccctgaaaaaaactaggctcagaatccactctcatttcatctcccctgatttgatctgaaaagattttgtttagagtactacatgaatatattataaaacatgggacaatcagaattgatagtaagaaggcaagtggctctatttgtacttcctctcaatagctcctaaaggtaatgctaccattttctgtttgtacatagtcttccagactttaaatttttgaacatataaatattatcatcttaaagacgtatggaaaaaaccattttgaataggttattccaaaatgtaatttaacagattgctctggaggattgtttgtttgtttgttttggagacagagtcccgcttggttgctcaggctgcagtgcagtggcacaaacacagctcactgcaacctctaactcctgcaaacacagctcactgcaacctctaactcctgcaaacacagctcactgcaacctctaactcctgcaaacacagctcactgcaacctctaactcctgcaaacacagctcactgcaacctctaactcctgggctcaagcagtcctttcacctcagcctcctgagtagctggaccatgacacctacctaactttttattttttgtaaagaggggaatcactatgttgcccaggctggtctcaaactcctgggctcaagcaatccttcctcagcctctcaaagagttgggtttacaggcgtgagccaccgcacctggctcctggagcatttctgatgtgaacatgtgctgatctaacaccactccttttaccagctgcctgttctagagcaaaccatcttttttgagcattccactttggctaggcccttaggctgttagcagttttcatcgctactggcaaagctgcagtggacgttctcctgcacatataacctcttgatgccactgtatgagtgagtctctgcaaaatgagaagtagaattgctggggtgaaaggcatacatactaacttttttgattaattccacccatgtaccctgatttgggcagaattttaatctcactgtgaaatcagagctttgttctagagcctttcttgggggttccatggatcagtgggtcagccgtcacttgtgccctggcccatcctctgtccagcttgggcagcatgcatcattcattctgattccttaatttgccatatgtgaaaacatggtaatctatacattacttgggtgctattattatatataactagctttggagtcagaattagcgtctcatcctggctctaccactttccaactgtgcgactgtggccaagtgactccccttctctgagcctcagttttcctcttctgtaaaatgggggtaaagggataagaactatagggggatctcaggggatggttaagagaaatccatgagataagcaaacacattatctagtttagtaaagctaagcaatgaagacttaacagccccatggtgaaggcttaatacatggtagctataatgattactattaatattgtgaaataaaaggttgtgatgaaccaaccatatcttctca

SEQ ID NO: 196792 - DNA, 1968 bp, Homo sapiens
  Payload ID: 18811
  Gene Name: tyrosylprotein sulfotransferase 2
  Uniprot ID: O60704
  ENST ID: ENST00000398110
  CDS Start-End: 306-1439
aaaggagcctcccagctaaaagccagcaggagagagaccttggccaccaagggtctgccagctcctggtggtccccactccagccacctgccagctcgagcctgaccctcgcctccaccctggctgctgcctgtaccgctctcagggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatg

SEQ ID NO: 196793 - DNA, 2084 bp, Homo sapiens
  Payload ID: 18811
  Gene Name: tyrosylprotein sulfotransferase 2
  Uniprot ID: O60704
  ENST ID: ENST00000403880
  CDS Start-End: 422-1555
aaattctactgcagtggagtccatcttcacagtcatatgagccccctgaaattgacttccatagttctttaccttcaaggtcttattgttgggctctgccagcagacagccttggcacacaggcacaagggctggagcccagagatgagagtgcccaagggagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtcttgaaaggggactataaaacaccagccaatctgaaaggatattttcaggtgaaccagaacagcacctcctcccacttaggaagctcgtgatttccagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatg

SEQ ID NO: 196794 - DNA, 582 bp, Homo sapiens
  Payload ID: 18811
  Gene Name: tyrosylprotein sulfotransferase 2
  ENST ID: ENST00000454778
  CDS Start-End: 223-582
attgcagggctgatggctgagcctgagcacgtgggcactgggccctgctccagggccactctggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaag

SEQ ID NO: 196795 - DNA, 514 bp, Homo sapiens
  Payload ID: 18811
  Gene Name: tyrosylprotein sulfotransferase 2
  ENST ID: ENST00000453117
  CDS Start-End: 369-514
ttacttctgtaacatagctactggaaaactgagaatttgaagtgtgtctcacactgcatttctattgggtggcgctgttacaaactacaggaaggagctagaattctgtggaaggttttaggcaggggctgacatcctctggccaaaatgacaagagggaattccagagaccagggcaagtctggccacagggagactgcatggcctaggagacctgagccacagccgccaagagaagccctgattccccagagaggaggtgcccgctgccagtccacagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagca

SEQ ID NO: 196796 - DNA, 675 bp, Homo sapiens
  Payload ID: 18811
  Gene Name: tyrosylprotein sulfotransferase 2
  ENST ID: ENST00000445720
  CDS Start-End: 1-507
gacttcctcggcatcgcctggagcgacgctgtcctccaccatgaagacctcattggcaagcccggtggtgtctccctgtccaagatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtgagtgtgcacctgtacttgtggaagtgtactcttggggatatggggcttctgcagatgtggaaactccagccacctgaggaaatgttcagtctctcaattcctggtcatctgatttgttcctgtctgatggacacagtgaactacatgattgcttgtatttccattttgcttgggctgcagggaagctcaaagccaactggtagcctgtctctcatactctaacatctaacagcaggccagcttgtacactaatttcatcttatttctctaattttatttacatttttacccctatttccctggctatttgtttatctgtttgtaaggcacctcaagtctttgttgagagggggtataaataaataaactattggtccctttcttgtctta

SEQ ID NO: 196797 - DNA, 586 bp, Homo sapiens
  Payload ID: 18811
  Gene Name: tyrosylprotein sulfotransferase 2
  ENST ID: ENST00000442495
  CDS Start-End: 162-586
cttccccggctggggcggctggagagccgggagtcgctgggtgcgtggggctgcctcgccgcgtctcgccacgatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcct

SEQ ID NO: 196798 - DNA, 544 bp, Homo sapiens
  Payload ID: 18811
  Gene Name: tyrosylprotein sulfotransferase 2
  ENST ID: ENST00000450022
  CDS Start-End: 404-544
cttccccggctggggcggctggagagccgggagtcgctgggtgcgtggggctgcctcgccgcgtctcgccacgggctctgccagcagacagccttggcacacaggcacaagggctggagcccagagatgagagtgcccaagggagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcct

SEQ ID NO: 196799 - DNA, 544 bp, Homo sapiens
  Payload ID: 18811
  Gene Name: tyrosylprotein sulfotransferase 2
  ENST ID: ENST00000440953
  CDS Start-End: 353-544
cttccccggctggggcggctggagagccgggagtcgctgggtgcgtggggctgcctcgccgcgtctcgccacgtgtggtttctatttgttggcgattttgctgtgtggtagagtcgtgctcaccctgcacccacgtgggcctttcttagcttaaaatggagaacatgccaccacctgcctgactgggctgatggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctat

SEQ ID NO: 196800 - DNA, 3238 bp, Homo sapiens
  Payload ID: 18812
  Gene Name: tyrosyl-tRNA synthetase
  Uniprot ID: P54577
  ENST ID: ENST00000373477
  CDS Start-End: 910-2496
ctgtgctgtgcgctcctctcccggggaccaccgtcctcagatctccccagggaatgggtcgtcctcttcctgcccccacccgcgagacgcggcagaaaagcccgcggctatcttcccgccagcaacagcctcccgccgagccggccgggacagaggcggcccccacccccactgggcaggggactgcagacggcgctccccgactctcaagacgaccagggagcttcccttttcctcagcggggtgaggggcatctgtcgcccgccgacttggaggtggaggggcagggacattccctcgccatcacctcaggagctagaacgcgcccttctcgcagcagggcgtgggcctcccaatccctccaaggggcggacggcgtgcgcaaccccctggagaagcaacaggcgcccccatccccctccaagccgggtaacgccgaccccctcgtccctcccgctcttcacctccggaagccgggccaaagcctgggcgaacgactgcgcctcactccgccccctgcgccattttatcgccccctccccgacctcccctaccccgagtcagccgggccaacaccagggggagggcaaaccagcagtgattggcaggaaaccgtcccgcctctaggagggttgtgccccgctcaggcgcctcagccccgccctccgcaccgcccaccgtgcccactggctccaccttttcccgtctcatcgacctgctcgactctctgctgctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccaggatcatcctgtctggctgcagtgagagaccaacccctaacaagggctgggccacagcagggagtccagccctaccttcttcccttggcagctggagaaatctggtttcaatataactcatttaaaaatttatgccacagtccttataattggaaaaatactggtgcccaggttttcttggagttatccaagcagctgcgcccctagctgggatctggtacctggactaggctaattacagcttctccccaacaggaaactgtgggatttgaaaaggaaagggaagggaaaacagagaacctagtggtctaccaagtggttggcaactttcccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcatctcagtcaaatccccatcactgtcataaattcaaataaaatgtctgaacaaggg

SEQ ID NO: 196801 - DNA, 1167 bp, Homo sapiens
  Payload ID: 18812
  Gene Name: tyrosyl-tRNA synthetase
  ENST ID: ENST00000616261
  CDS Start-End: 1-1167
atgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctttggatgaagagtatttaaaagtagatgcccaatttggaggcattgatcagagaaagattttcacctttgcagagaagtacctccctgcacttggctattcaaaacgggtccatctgatgaatcctatggttccaggattaacaggcagcaaaatgagctcttcagaagaggagtccaagattgatctccttgatcggaaggaggatgtgaagaaaaaactgaagaaggccttctgtgagccaggaaatgtggagaacaatggggttctgtccttcatcaagcatgtcctttttccccttaagtccgagtttgtgatcctacgagatgagaaatggggtggaaacaaaacctacacagcttacgtggacctggaaaaggactttgctgctgaggttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggcctgccaagaattcagaaccagaggaggtcatcccatcccggctggatatccgtgtggggaaaatcatcactgtggagaagcacccagatgcagacagcctgtatgtag

SEQ ID NO: 196802 - DNA, 2122 bp, Homo sapiens
  Payload ID: 18813
  Gene Name: tyrosyl-tRNA synthetase 2, mitochondrial
  Uniprot ID: Q9Y2Z4
  ENST ID: ENST00000324868
  CDS Start-End: 29-1462
ccagcattcccttcgtgccgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtgtgagtaacttcattatttttatgggccggttaataaatatttgtttaataatgggatgttttattttctgatgtacaaagcttgattaccatagaaaaccatgattttcagggttaatctctttttaaaattatacttcagaagagaaagaaatgctgctttcctatcttacccttcctgctctcctttttgtagtgatgaggaacaatgaaaaagaggtagtgtaaggaattgtgaggctgggcatggtggctcacacctgtaatcccagcacttcgggaggccaaggtgggcaaatcgcttgaggccaggagtttgagaccagcctggccaacagggcgaaaccccgtctctactgaaaatataaaaattagccagatgtggttgcaggcacctgtaaccccagctactcaagaggctgagctgcgagaatcacttgaacccaggagatggaggttgcagtgagctgagatcacgccactgcactccagcctgggagacagcatgagtagtgagtgaaactctgtctca

SEQ ID NO: 196803 - DNA, 1321 bp, Homo sapiens
  Payload ID: 18813
  Gene Name: tyrosyl-tRNA synthetase 2, mitochondrial
  ENST ID: ENST00000548490
  CDS Start-End: 1-876
gggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtga

SEQ ID NO: 196804 - DNA, 962 bp, Homo sapiens
  Payload ID: 18814
  Gene Name: U2 small nuclear RNA auxiliary factor 1
  Uniprot ID: Q01081
  ENST ID: ENST00000291552
  CDS Start-End: 94-816
cgtcgtcgcgtccgggtgacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 196805 - DNA, 940 bp, Homo sapiens
  Payload ID: 18814
  Gene Name: U2 small nuclear RNA auxiliary factor 1
  Uniprot ID: Q01081
  ENST ID: ENST00000380276
  CDS Start-End: 72-794
ctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 196806 - DNA, 1019 bp, Homo sapiens
  Payload ID: 18814
  Gene Name: U2 small nuclear RNA auxiliary factor 1
  Uniprot ID: Q01081
  ENST ID: ENST00000398137
  CDS Start-End: 371-874
gtccgggtgacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagt

SEQ ID NO: 196807 - DNA, 1675 bp, Homo sapiens
  Payload ID: 18814
  Gene Name: U2 small nuclear RNA auxiliary factor 1
  Uniprot ID: Q01081
  ENST ID: ENST00000459639
  CDS Start-End: 1026-1529
ccctccctgacattgctggcacacaggcatgattgctggttccattggatatggatctggattgtcagcgtatttgaacagtattaagggagggttttgcagtagagacagaaggtgacgtaaggtggttcctaaggtgggttcggtcagtcccctaatagtttgttttcagtgtattgagaccaggagaattgatttacttcagacctattttttgaaactccctgttggtctggtgtcatgcgtttagagagactctgaacttcgttttctgttttccttagataatgatagcacttcatgagcaccatatgtgaagcacacatacgttctgtctgactctcagaacagtgccacattggcattgtcatcatttacagatgacatctgagagctagggtgacttgcccaagcccaagcagctggtagcagagttgggatcttaaccctcaccacaccggtgttttcaagagagaacttggtcgtggagaactggagaacagatactgcctaagttacatttagttttagactaatttaatactccatttaagaaacaaacagaacagctgtgcagttaggaaagtggaggggatttgaatgaggaggaggcgggttagagttagaaccgtctttgctgaacaagtagtgtgtttgcagaaagggaagttgaagttacgttgtcctaaaatacagcaaggaagaggaggtgcttaataccacggaaaaaagtctgtgtcatgtttctgtgaggttaaaagtaatttgatagtgtatgtcatgctgctgacatattccatgtgtttgatatcttcccagcaaaataatcagctctcattttcccttacagagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 196808 - DNA, 966 bp, Homo sapiens
  Payload ID: 18814
  Gene Name: U2 small nuclear RNA auxiliary factor 1
  Uniprot ID: Q01081
  ENST ID: ENST00000464750
  CDS Start-End: 31-258
gtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 196809 - DNA, 729 bp, Homo sapiens
  Payload ID: 18815
  Gene Name: U2 small nuclear RNA auxiliary factor 1-like 4
  Uniprot ID: Q8WU68
  ENST ID: ENST00000292879
  CDS Start-End: 55-663
cctaagcaacggaagtgacgtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggc

SEQ ID NO: 196810 - DNA, 747 bp, Homo sapiens
  Payload ID: 18815
  Gene Name: U2 small nuclear RNA auxiliary factor 1-like 4
  Uniprot ID: Q8WU68
  ENST ID: ENST00000378975
  CDS Start-End: 15-560
gggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggc

SEQ ID NO: 196811 - DNA, 904 bp, Homo sapiens
  Payload ID: 18815
  Gene Name: U2 small nuclear RNA auxiliary factor 1-like 4
  Uniprot ID: Q8WU68
  ENST ID: ENST00000412391
  CDS Start-End: 52-714
aagcaacggaagtgacgtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccagaccatagtgctgctcaacctgtaccggaatccacagaacacagcccaaactgcagacggatcacactgtcatgtgagtgacgtggaggtgcaggagcactatgatagcttcttcgaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatc

SEQ ID NO: 196812 - DNA, 1036 bp, Homo sapiens
  Payload ID: 18815
  Gene Name: U2 small nuclear RNA auxiliary factor 1-like 4
  ENST ID: ENST00000587987
  CDS Start-End: 24-143
agacctggagggcttgggtaaaaatggctgaatatttagcttcgatattcgggactgagaaggacaaatcggggtctgccggcacggggaccggtgctcccggcttcacaacaagccgacattcagccagccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccaggttcaagcaattctcctttctcagcctcccaagtagctgggattataggcacctgccaccatgcctggctaatttttgtatttttagtagagatggggtttcaccacgttggccagcctggtctcgaactccggacctcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggca

SEQ ID NO: 196813 - DNA, 561 bp, Homo sapiens
  Payload ID: 18815
  Gene Name: U2 small nuclear RNA auxiliary factor 1-like 4
  ENST ID: ENST00000591057
  CDS Start-End: 28-183
agccagacctggagggcttgggtaaaaatggctgaatatttagcttcgatattcgggactgagaaggacaaatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggcatcaacttgcttttgctgtggtttggcatttccctccacccacacatgtgacgaaaaggggaaacaag

SEQ ID NO: 196814 - DNA, 263 bp, Homo sapiens
  Payload ID: 18815
  Gene Name: U2 small nuclear RNA auxiliary factor 1-like 4
  ENST ID: ENST00000587886
  CDS Start-End: 234-263
gagcagccagacctggagggcttgggtaaaaatggctgaatatttagcttcgatattcgggactgagaaggacaaccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccac

SEQ ID NO: 196815 - DNA, 455 bp, Homo sapiens
  Payload ID: 18815
  Gene Name: U2 small nuclear RNA auxiliary factor 1-like 4
  ENST ID: ENST00000601236
  CDS Start-End: 26-226
ccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccaga

SEQ ID NO: 196816 - DNA, 702 bp, Homo sapiens
  Payload ID: 18815
  Gene Name: U2 small nuclear RNA auxiliary factor 1-like 4
  ENST ID: ENST00000594792
  CDS Start-End: 1-102
tcccggcttcacaacaagccgacattcagccagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggca

SEQ ID NO: 196817 - DNA, 525 bp, Homo sapiens
  Payload ID: 18815
  Gene Name: U2 small nuclear RNA auxiliary factor 1-like 4
  ENST ID: ENST00000589429
  CDS Start-End: 1-111
agtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccagtagagatggggtttcaccacgttggccagcctggtctcgaactccggacctcaggctcccgggctccataatgtaatctgttcagcatggagaccttcttctaccgcccctgtcttaataaagctgcgtgtttcacttcggc

SEQ ID NO: 196818 - DNA, 525 bp, Homo sapiens
  Payload ID: 18815
  Gene Name: U2 small nuclear RNA auxiliary factor 1-like 4
  ENST ID: ENST00000600296
  CDS Start-End: 1-214
ccggcacggggaccggtgctcccggcttcacaacaagccgacattcagccagccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggca

SEQ ID NO: 196819 - DNA, 723 bp, Homo sapiens
  Payload ID: 18815
  Gene Name: U2 small nuclear RNA auxiliary factor 1-like 4
  ENST ID: ENST00000591084
  CDS Start-End: 1-123
tgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccagagatggggtttcaccacgttggccagcctggtctcgaactccggacctcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaa

SEQ ID NO: 196820 - DNA, 963 bp, Homo sapiens
  Payload ID: 18816
  Gene Name: U2 small nuclear RNA auxiliary factor 1-like 5
  ENST ID: ENST00000620065
  CDS Start-End: 31-258
gtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataaca

SEQ ID NO: 196821 - DNA, 813 bp, Homo sapiens
  Payload ID: 18816
  Gene Name: U2 small nuclear RNA auxiliary factor 1-like 5
  ENST ID: ENST00000619610
  CDS Start-End: 31-753
gtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagt

SEQ ID NO: 196822 - DNA, 897 bp, Homo sapiens
  Payload ID: 18816
  Gene Name: U2 small nuclear RNA auxiliary factor 1-like 5
  ENST ID: ENST00000610664
  CDS Start-End: 29-751
cgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 196823 - DNA, 1675 bp, Homo sapiens
  Payload ID: 18816
  Gene Name: U2 small nuclear RNA auxiliary factor 1-like 5
  ENST ID: ENST00000623375
  CDS Start-End: 1026-1529
ccctccctgacattgctggcacacaggcatgattgctggttccattggatatggatctggattgtcagcgtatttgaacagtattaagggagggttttgcagtagagacagaaggtgacgtaaggtggttcctaaggtgggtttggtcagtcccctaatagtttgttttcagtgtattgagaccaggagaattgatttacttcagacctattttttgaaactccctgttggtctggtgtcatgcgtttagagagactctgaacttcgttttctgttttccttagataatgatagcacttcatgagcaccatatgtgaagcacacatacgttctgtctgactctcagaacagtgccacattggcattgtcatcatttacagatgacatctgagagctagggtgacttgcccaagcccaagcagctggtagcagagttgggatcttaaccctcaccacaccggtcttttcaagagagaacttggtcgtggagaactggagaacagatactgcctaagttacatttagttttagactaatttaatactccatttaagaaacaaacagaacagctgtgcagttaggaaagtggaggggatttgaatgaggaggaggcgggttagagttagaaccgtctttgctgaacaagtagtgtgtttgcagaaagggaagttgaagttacgttgtcctaaaatacagcaaggaagaggaggtgcttaataccacggaaaaaagtctgtgtcatgtttctgtgaggttaaaagtaatttgatagtgtatgtcatgctgctgacatattccatgtgtttgatatcttcccagcaaaataatcagctctcattttcccttacagagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagta

SEQ ID NO: 196824 - DNA, 1698 bp, Homo sapiens
  Payload ID: 18817
  Gene Name: U2 small nuclear RNA auxiliary factor 2
  Uniprot ID: P26368
  ENST ID: ENST00000308924
  CDS Start-End: 41-1468
gaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctggtgagccccccgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggacgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaac

SEQ ID NO: 196825 - DNA, 3022 bp, Homo sapiens
  Payload ID: 18817
  Gene Name: U2 small nuclear RNA auxiliary factor 2
  Uniprot ID: P26368
  ENST ID: ENST00000450554
  CDS Start-End: 960-2375
gcaacctccgcagcggtcgcgcgcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggacgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctccttctcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttt

SEQ ID NO: 196826 - DNA, 849 bp, Homo sapiens
  Payload ID: 18817
  Gene Name: U2 small nuclear RNA auxiliary factor 2
  ENST ID: ENST00000592874
  CDS Start-End: 1-259
tcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgagtgaaatattgtggggctgagatccctcgtagcaacaaaaagtttgctaccatcgtcgaaggcaagccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggtgagtccccggtcgctggccgctgccgcgtctgtccttccctgccctgcgctgttgccaagccatggtctcc

SEQ ID NO: 196827 - DNA, 1104 bp, Homo sapiens
  Payload ID: 18817
  Gene Name: U2 small nuclear RNA auxiliary factor 2
  ENST ID: ENST00000590551
  CDS Start-End: 10-933
caggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggacgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttgggggg

SEQ ID NO: 196828 - DNA, 778 bp, Homo sapiens
  Payload ID: 18817
  Gene Name: U2 small nuclear RNA auxiliary factor 2
  ENST ID: ENST00000587196
  CDS Start-End: 1-155
cggacttcgacgagttcgagcggcagctcaacgagaataaacaagcctctagccctgcccctctcagggacgaccctggggtcaggcccctcagccctcgagggggaccaggagccagcctcctctgtcttctctggctccccagctcctcctgagcatcctcagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgagtgaaatattgtggggctgagatccctcgtagcaacaaaaagtttgctaccatcgtcgaaggcaagtaaggtccattctgactttctcaacctgcactttgctacatttgataaaccagcccccggactccagggccagattcctccacatcactcttttctcctcccctcccgtcc

SEQ ID NO: 196829 - DNA, 1267 bp, Homo sapiens
  Payload ID: 18818
  Gene Name: U2 snRNP-associated SURP domain containing
  ENST ID: ENST00000467348
  CDS Start-End: 1-871
tattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataa

SEQ ID NO: 196830 - DNA, 588 bp, Homo sapiens
  Payload ID: 18818
  Gene Name: U2 snRNP-associated SURP domain containing
  ENST ID: ENST00000493782
  CDS Start-End: 106-588
tattcagccttgcaggcgcctctggcgggcttcactgagatccgctctttcggtgctcgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatct

SEQ ID NO: 196831 - DNA, 7276 bp, Homo sapiens
  Payload ID: 18818
  Gene Name: U2 snRNP-associated SURP domain containing
  Uniprot ID: O15042
  ENST ID: ENST00000473835
  CDS Start-End: 91-3180
gcgcctctggcgggcttcactgagatccgctctttcggtgctcgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactcccatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtaggtgagagaaaataagtaagtcttgatctgtttcttaccaaagagagacagacctatgatggaaaatgatcacgtctctgaattttttctttaacgttatagttccttattacagatagtaagcatatgggaatttctgagctataacatgttgagaagttagaaattaaaactaacacaacaaaaggcgctgaatcaaaagatctttgcttttatttggctcagaatgtttttggcttttctgctaaagatggcagaaattactctacacagacctgatttttctttattgcagaccattcttgtgggcttaccctgagacttttatcccaattagtgaatcttggagggaatacttgcttatttatgacttaggtatttccccccaaactttaatattcttgagcacttgaaaatacttttgagaaattttaactgtgattaaatttaggtttattagaaatattctgtacacatttgcctccatggtggcgtaagttctgaaaaattatatgaccgtgacaatagtttatcatcatcattattgttattcaaaataagggtaaataaatctctgtattgccaaagtgacttaaactgttctgatgaccacacagtgtgatttctttagcagagaaagttggttttaaaaataaatagtaccacttttctaagactgtacagtttacaaataaggtttttttctttgttgttttcctcttctattaagttttagtgaaaagcctaattacagaaaattgtgcagatactagtgaagatactagtataagtttaaaggaacacgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctacataaagattatatagttgcaaacaaaggttgtgaaatttcccttttgttgtttttgacttttaattaataaaagtacattgttttcatagcaaa

SEQ ID NO: 196832 - DNA, 4364 bp, Homo sapiens
  Payload ID: 18818
  Gene Name: U2 snRNP-associated SURP domain containing
  ENST ID: ENST00000463563
  CDS Start-End: 1-1320
ctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaagaagaaattcctattattgtcatgaacactggacatactagaaactttcttttcatggtaacaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgaca

SEQ ID NO: 196833 - DNA, 571 bp, Homo sapiens
  Payload ID: 18818
  Gene Name: U2 snRNP-associated SURP domain containing
  ENST ID: ENST00000465175
  CDS Start-End: 180-571
atagccaaggttaatgtacagtctacacgtggtctttaccttaacgggaagtaaaaagcacttttgagggtagaggactcgtggtctctttctttatgttgaagaaacagtgaaaagagaagctccgtagacttacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatc

SEQ ID NO: 196834 - DNA, 3491 bp, Homo sapiens
  Payload ID: 18818
  Gene Name: U2 snRNP-associated SURP domain containing
  ENST ID: ENST00000493598
  CDS Start-End: 9-3095
agctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcaggcaaattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataa

SEQ ID NO: 196835 - DNA, 3557 bp, Homo sapiens
  Payload ID: 18818
  Gene Name: U2 snRNP-associated SURP domain containing
  ENST ID: ENST00000488497
  CDS Start-End: 462-1739
agctgccgaagcggcaagaacagcgtttccgtccatcgagcgccaggtcaccagtcagctccagtcctattttgagttgaagtaaaagctcctccctagatggccagtgcacgtctttaaaaagcgactcctttcccacaaaggaaatacgactggttcgcatctatcaagggttggcgttgggataagagggtgaagtatcagctggccctgattctctgaattcccggacccaataacgcgaccaagcaccgtgactcccaggaaaactagcggagtgagcgcggctgaggaaattactgacaccggaagtcacgtgagcggctgcccctaaggtcgctatctcgacagtcgactattcagccttgcaggcgcctctggcgggcttcactgagatccgctctttcggtgctcgactcgcccgtgctgctgccgccgccgaaggaggggcaaagctcaagatggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagagaaagagaaagagttagaaagagaacgagaaagagacaagaaagataaagaaaaattggaatctcgctccaaagacaagaaggaaaaagatgagtgtactccgacaaggaaggaaaggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtg

SEQ ID NO: 196836 - DNA, 725 bp, Homo sapiens
  Payload ID: 18818
  Gene Name: U2 snRNP-associated SURP domain containing
  ENST ID: ENST00000600150
  CDS Start-End: 350-725
ggactggctgctcaaactccacaatttaatgaaaaatctcagatgatgactcagaaaacctctaatgatctgaggaatatattaagggattccagagtcaaaggctgatcatggagggcattgatgagggaagacttcagcacgtttttcagcaccaggacaagcatcattgctcaaggagagcttggttgacaacaggaagttagaaggagtctgaattgtaacaagtgtggcaagagcaccaagatcactgtgtgtgtgtgttcacagaaaatgtaccaaagggagaagccttaaaaacaaatggcaggtgtgggcaccagaaaatcaacacatcgggaagagaaaaatggcatggttttactgtaattgtaaaaagatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaag

SEQ ID NO: 196837 - DNA, 8478 bp, Homo sapiens
  Payload ID: 18819
  Gene Name: U2AF homology motif (UHM) kinase 1
  Uniprot ID: Q8TAS1
  ENST ID: ENST00000489294
  CDS Start-End: 159-1418
ggtgtcatggctgcttgaagtcccgggagtcggtgaggcggctgcaggtccctccctgcggagccgctggtccggctggcggagatgtgaccgcgggcccggccggcctgcctcaggcgtcgcgtcagctcccgtgtccgtgcccttaacccacaccgatggcgggatccggctgcgcctggggcgcggagccgccgcgttttctggaggccttcgggcggctgtggcaggtacagagccgtctgggtagcggctcctccgcctcggtgtatcgggttcgctgctgcggcaaccctggctcgccccccggcgccctcaagcagttcttgccgccaggaaccaccggggctgcggcctctgccgccgagtatggtttccgcaaagagagggcggcgctggaacagttgcagggtcacagaaacatcgtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 196838 - DNA, 8117 bp, Homo sapiens
  Payload ID: 18819
  Gene Name: U2AF homology motif (UHM) kinase 1
  Uniprot ID: Q8TAS1
  ENST ID: ENST00000545294
  CDS Start-End: 1-1038
atgtttcttaccagaccgaaggtctgtgttgaccttaaccggagagtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaagatgttgtagaagatgtaaaagaggagtgtcaaaaatatggaccagtggtatctctacttgttccaaaggaaaatcctggcagaggacaagtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaaggagttgctttttaatttc

SEQ ID NO: 196839 - DNA, 8446 bp, Homo sapiens
  Payload ID: 18819
  Gene Name: U2AF homology motif (UHM) kinase 1
  Uniprot ID: Q8TAS1
  ENST ID: ENST00000538489
  CDS Start-End: 197-1231
atttccggcttctgggactcgggtgcaccacggcttccggtgtcatggctgcttgaagtcccgggagtcggtgaggcggctgcaggtccctccctgcggagccgctggtccggctggcggagatgtgaccgcgggcccggccggcctgcctcaggcgtcgcgtcagctcccgtgtccgtgcccttaacccacaccgatggcgggatccggctgcgcctggggcgcggagccgccgcgttttctggaggccttcgggcggctgtggcaggtacagagccgtctgggtagcggctcctccgcctcggtgtatcgggttcgctgctgcggcaaccctggctcgccccccggcgccctcaagcagttcttgccgccaggaaccaccggggctgcggcctctgccgccgagtatggtttccgcaaagagagggcggcgctggaacagttgcagggtcacagaaacatcgtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggcaaacagttctgctattattgatcacatatttgccagtaaagcagtggtgaatgccgcaattccagcctatcacctaagagaccttatcaaaagcatgcttcatgatgatccaagcagaagaattcctgctgaaatggcattgtgcagcccattctttagcattccttttgcccctcatattgaagatctggtcatgcttcccactccagtgctaagactgctgaatgtgctggatgatgattatcttgagaatgaagaggaatatgaaggtctttgttgagtatgcaaatgctggtgattccaaagctgcgcagaaattactgactggaaggatgtttgatgggaagtttgttgtggctacattctacccgctgagtgcctacaagaggggatatctgtatcaaaccttgctttaatcagtaacctaaggactgtttcctttttctcctcttccatttcttgggttattccacatatgaatgcaggactacccccttaccattttaagaaggtactttatacatttatttaatcctactaatgtgcagccattgcccaagcagtgactgcgttgcatacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaaggagttgctttttaatttc

SEQ ID NO: 196840 - DNA, 581 bp, Homo sapiens
  Payload ID: 18820
  Gene Name: U51561.1
  ENST ID: ENST00000625149
  CDS Start-End: 31-564
agttggaacctcccactgacagccagaacgatgagccactcccgaagagctgctcctactcaggaccaatgccacactccaggattccccacctcccgtgaaaccagtgggagcatatggcaggccaggatctgtggatctttacaggctctggacacatggcgaacacacatccccagaaagagcccagctcccactcaggcatcacagatctgtctgctgttgcctgaaagcccctggagaaatcccacaccccggggatttcttaaacctttgattaactgggatgctatcctgtacttcaaagaaaagaggaatatccaagtaacaacacaagctcatccccagaaccaggccagctgcagctctcaggaggtagccacacccgggctagtgccactggcagctgcaccaaaggtgtatgagcggtcacatgataacctgaacgctgaggcccaaggactggcaggtgctcaggtgtcgaaaccacagaatcccattaccaggctctgttctctgaaggaacagtcaatcttgaagatcttcactaagcagagcatctgaggtttaccggcttgaag

SEQ ID NO: 196841 - DNA, 2282 bp, Homo sapiens
  Payload ID: 18821
  Gene Name: U6 snRNA biogenesis 1
  Uniprot ID: Q9BQ65
  ENST ID: ENST00000219281
  CDS Start-End: 112-909
gcggtgccagcccaggccccgcccctgggagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttgga

SEQ ID NO: 196842 - DNA, 1217 bp, Homo sapiens
  Payload ID: 18821
  Gene Name: U6 snRNA biogenesis 1
  Uniprot ID: Q9BQ65
  ENST ID: ENST00000423271
  CDS Start-End: 78-638
gcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagcccccatccaggacctcattgcctcattggaaccaaagatgcccctgtcacccaggaaattccaaaggatttaggagctctgcgtcaggagccaggatcacagaccagataatagaacaaaagatgctcctagcacccctgctgcttaggaaatgacacaggttttaggatctctgtgtcaggaactggaggctgagaccaacacatatgttatcatttcacagtgataggtcaaacaggtcatggtaatggtgggagctacctcactgggggcctatgggggtgaaaggagatcatgggtgccctcagcacaccacttgggtgaagggttagtaccagaccccacttctggttttgtctgccagcctggggctttttttttccccttacctattagattatttcataactcttttcctaccagaaatgcatctcctgctagactggtccagatcaaaaccctgctctttcactgaggctctcccggttggcatatcctgcagaatccctccgtccagagatcagtcggtcctgtggttgtttcacaggtgactcctctgtccagagatcagtcggtcctgtggttgtttcacaggtgacacctccgtccagagatcagttggccctgtggttgtttcacaggtgacccctccatccagagatcagttggtcctgtggttctttacccctg

SEQ ID NO: 196843 - DNA, 1212 bp, Homo sapiens
  Payload ID: 18821
  Gene Name: U6 snRNA biogenesis 1
  Uniprot ID: Q9BQ65
  ENST ID: ENST00000539737
  CDS Start-End: 80-823
gcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctcttcctctcctctctcttcctctcctctctctacccctcctgtctctcctcccctcctctctcttcctc

SEQ ID NO: 196844 - DNA, 1751 bp, Homo sapiens
  Payload ID: 18821
  Gene Name: U6 snRNA biogenesis 1
  ENST ID: ENST00000563149
  CDS Start-End: 65-556
cggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggtgccagaagcccatgccagaagcccaacccaaagtggcttaaaccaaagagaaatttataggctggtataactaaaagattcagaggtagcactggctcatgcatgagtggaccggggtgacaagatatcagatggcacctgactgtcaccaccacaggcagactgttcaccatctcagctctgtccccttcctttgtcacaatgacgaagccaccgcatctcccggctaatggtgtaccagcctggaaagacagcctccctctctgattggcttcagcacaagtcacaggaatgactgcctggtctgacccgtctcctgtgtgctttctttgggagtaaagagttaacaggcccttcccccttccacagagagtgcttcccttatcctgcggaagctctgcccctggatgaaggaggagagcggctatgttagtgctgatgactggcacactgcacttgcgctaggaagacagcatgaactgcacccctccagggaagccacggcctgggctcccctgcatacagtggttccttaactgggcacgagtcccttgctgggacttaggaaaactctgcctaaagtccattgcaagaaatactgatccctgtgggatgtatatgtggctggttcccttgctcactgagagactagaaaacagcacctggacccctgggctggttccctctgaggaaaggatctgtgtcatgagtgaagcccgggcaggtgtggtctgttcaactttgatcatctggttgagcctaaggtgaccaagagtgggcggtgcacccctgattctgttgctgtgactgaggaaatgctaagctctgtttggccaggcctgggcagcctgcctctggagtaggggtggagagccatcctgcaacacgaggttaccaggagaaggagttttggttgggcacagacatccagtgtccactccaggatgtttgggagacaccttgagaactcttcctaaaagctgcacttaaccaagctcctggtggttctgtgatcccttacattttctccagaggcagagagttggctgactgacttttgcccttgggcagattgtgaggctctacccagcatgctggtatattatgttccctcagatgggggtgagacccttggcctgggggctgtaaaatgatctgtttctgtgaggagactttccatggtgagattgctagtgtctcagagaataaaggacagaaccagtccaagtcaaagca

SEQ ID NO: 196845 - DNA, 1135 bp, Homo sapiens
  Payload ID: 18821
  Gene Name: U6 snRNA biogenesis 1
  ENST ID: ENST00000561743
  CDS Start-End: 194-838
agatgcaacccacttccaggttcccagctcatctgcctcttacatttaaaagtttgtaagttttctcctgagcagaggaagaaggaaggagaagccttcacaggacagtctggcctctaactgctctgccaaagaaattggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccc

SEQ ID NO: 196846 - DNA, 558 bp, Homo sapiens
  Payload ID: 18821
  Gene Name: U6 snRNA biogenesis 1
  ENST ID: ENST00000564387
  CDS Start-End: 64-351
ggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacggatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctgg

SEQ ID NO: 196847 - DNA, 671 bp, Homo sapiens
  Payload ID: 18821
  Gene Name: U6 snRNA biogenesis 1
  ENST ID: ENST00000561568
  CDS Start-End: 124-671
gcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcggtgaggatggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaatt

SEQ ID NO: 196848 - DNA, 2596 bp, Homo sapiens
  Payload ID: 18822
  Gene Name: U82695.5
  ENST ID: ENST00000633844
  CDS Start-End: 221-1330
gggagcccgggtgactgttggcgccaagtgcctcagagagccacacgcttccacgctgcggagctgaggtgatctcttcagacccttcggagagacccagatatctgacttcccactgagagacccggaattgcccagagtttgagaaagctgtgtcggagactgcaacagtcagcacacattcctgattgatcaggctccctccctcaagtcctctgcgatggctctggcgatgcttcgggactggtgcaggtggatgggtgcgaacgcagagcgctccctgctcatcctgggtatccctgatgactgcaaggaacatgagttccaggaggccgtgcgggctgccctgtcgcccctgggcaggagggagcagccaggctgcgaggaagagtcctttgagagctgggtggagcatgccaaggatatgctgcagctgtggtgccatgcgtcggaaagggagaagaagaggtggctgctggagagcttgggcggcccggccctggaagtcgtgagcggcctcctggaggaagataccaacttgtccgcgctggactgcctggcggcgctggggcaggtatttaggaaccaggacactcgaatgacttcgaggctgaagttcctgacctgcacgcaggggccccaggaggggctgtttgccttcgtggtgcgcctggaaggcctgctgcagagggctgtggagaagggggccgtctgcccagccttggccaattacctgcgactacagcaggtgctgtcttgggcccgccccagcgaggcactccaggataccctgagagggatgcagctggagaagaggccacctggcttcctggggctgctccggctcatccgggagatggaggcatgggcagccttcccagcgaggagccagcagggtgtggcctgggcagcggccccagtggagagtgaagacccagctgctgcccaggcctccccagcccaggggaatgccagcgaggctggtcccggagcagaagatgctgccgaggccgcttctgccaccaaagaggctgcaaggggagcccctgccgctggggaaggtgaaagtgcccctgcaggccccgaaggcctaggtcaggcaaggcccatagaggtcccctggggctcctccccagcccggatgagcagtgctgtctgggtgttcccaagaggtcttagctggggtccagagggcctcatccaggtgagaggccaggaagccaggaaacccccactggaggggctccagaccatcttggaggagccggaaaacgaggatgaggatggggccggggacgagggccagcccaagtcctcccagggcaaataggctcctagggccccggggcctcctctcctctcaggcagcagcgccttggaggcagacagaggccaggccagggccagtccctcaccccacattcaggagtaagggccccccacctcccccaaggggctctggccaccacccccattccttccctgtgacccggatgaccacgtttgatacaaaatggggtggggagaggcgcccccccgctcccttgcacccagcacacccagccccagccccaaaccctgccgccacggggggctggcctggagggagccctgagtgggcagctgtggcctgggtgggggcacctgaagatgtctgcccccaacccaggccgtgagttgggagagacagggggaaagaggccctctcaaggttgccagctgcctgggtctctcaagaggggtcagcccacttgccatctccggggcaggctgccctctgttccgggaagctcaccctcacctgtgtgacccacgcgcccagcagacgcccacccactgctagccatcatttctgcgaaaagtcatgtactgtgcgcccatgcaggcggccacctctgggcccggggcacgtgctgtgagcttcctgcgagcccaggctctgcttgctgctgtcctgcatcgtgagcaccacctctgctttcctggcgtagatctaggccaggggctgcttgttctcgtggagctgcgtgtgttcttctctgagcagcctctccccggagacccccagcgcagtcccaggagatggcgggaaggaggcaccagggcacggcggacgctcaccccgtgaccacgatggtgaccctgactgcgggaagaagaaccggacccggggcacagcggggctgcgtgaggatccacaagaactatgctttggcgtttcacccctgttgttacttgtgactcagtttcttcagcctggtggggtgttccctggtgtttcccagtgttctgtgactgtcctgtgaaggccatagggatgggctcaggagggggctccctgaagccagtggacactgccagagtccactgtcctggcaaaaggcagaccctggggccctcgggaaggagggaggtggcagcgggggcagcagcgggagggggagcagatgacgtgccttgccaggaaccccaggaggagggggcctgggacctgtgtcctgtggtggctgtttacagtttctctctgtattgtggtttccttctcttcaatagtttcagtatatgtttctcttcaataaatttcattccgtgttcc

SEQ ID NO: 196849 - DNA, 2192 bp, Homo sapiens
  Payload ID: 18822
  Gene Name: U82695.5
  ENST ID: ENST00000445091
  CDS Start-End: 249-2192
gtggcttccgggagaaccaggggtttctgggagcccgggtgactgttggcgccaagtgcctcagagagccacacgcttccacgctgcggagctgaggtgatctcttcagacccttcggagagacccagatatctgacttcccactgagagacccggaattgcccagagtttgagaaagctgtgtcggagactgcaacagtcagcacacattcctgattgatcaggctccctccctcaagtcctctgcgatggctctggcgatgcttcgggactggtgcaggtggatgggtgcgaacgcagagcgctccctgctcatcctgggtatccctgatgactgcaaggaacatgagttccaggaggccgtgcgggctgccctgtcgcccctgggcaggtaccgagtactcaccaagcacttcagaaaggagctcggggccaaggcagccttggtggagttcgctgagtatttaaaccgaagcttgattccccatcaaataccaggcaatggggggccctggaaagtgatcttcctgccccaagtacctgttattgagtttcaggatatgcccagttttcctgcacagccccagggtcaagcagtagcaaaagctgcaggtgagggaggaggcgcaggtgaggcaggaggtgtaggtgaggtaggagcagcaggtgaggcaggaggcacaggtgaggcaggagcaacaggtgaggcaggagcagcaggtgaggcaggaggcgcaggtgaggcaggaggtgtaggtgaggcaggagcagcaggtgaggcaggaggcgcaggtgaggcaggagcagcaggtgagggaggagcagcaggtgaggcaggaggcgcaggtgaggcaggaggtgtaggtgaggcaggagcagcaggtgaggcaggaggcgcaggtgaggcaggaggtgtaggtgaggcaggagcagcaggtgaggcaggaggcgcaggtgaggcaggagcagcaggtgaggcaggaggcgcaggtgagggaagagcagcaggtgaggcaggagcagcaggtgaggcaggagctgtgggtgaggcaggagcagcaggtgaggcaggagctgtgggtgaggcaggagctgcaggtgaggcaggagctgtgggtgaagcaggagggacaaatgtaacaaaagcctgggtccagccttggcgctgcaccctacagcctgtgctggaaaacagggcctaccgggaattgagacccttttccaggagggagcagccaggctgcgaggaagagtcctttgagagctgggtggagcatgccaaggatatgctgcagctgtggtgccatgcgtcggaaagggagaagaagaggtggctgctggagagcttgggcggcccggccctggaagtcgtgagcggcctcctggaggaagataccaacttgtccgcgctggactgcctggcggcgctggggcaggtatttaggaaccaggacactcgaatgacttcgaggctgaagttcctgacctgcacgcaggggccccaggaggggctgtttgccttcgtggtgcgcctggaaggcctgctgcagagggctgtggagaagggggccgtctgcccagccttggccaattacctgcgactacagcaggtgctgtcttgggcccgccccagcgaggcactccaggataccctgagagggatgcagctggagaagaggccacctggcttcctggggctgctccggctcatccgggagatggaggcatgggcagccttcccagcgaggagccagcagggtgtggcctgggcagcggccccagtggagagtgaagacccagctgctgcccaggcctccccagcccaggggaatgccagcgaggctggtcccggagcagaagatgctgccgaggccgcttctgccaccaaagaggctgcaaggggagcccctgccgctggggaaggtgaaagtgcccctgcaggccccgaaggcctaggtcaggcaaggcccatagaggtcccctggggctcctccccagcccggatgagcagtgctgtctgggtgttcccaagaggtcttagctggggtccagagggcctcatccaggtgagaggccaggaagccaggaaacccccactggaggggctccagaccatcttggaggagccggaaaacgaggatgaggatggggccggggacgagggccagcccaagtcctcccagggcaaatag

SEQ ID NO: 196850 - DNA, 1867 bp, Homo sapiens
  Payload ID: 18823
  Gene Name: UBA domain containing 1
  Uniprot ID: Q9BSL1
  ENST ID: ENST00000371756
  CDS Start-End: 219-1436
ccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcagtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 196851 - DNA, 748 bp, Homo sapiens
  Payload ID: 18824
  Gene Name: UBA domain containing 2
  ENST ID: ENST00000355700
  CDS Start-End: 136-748
ccgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccacca

SEQ ID NO: 196852 - DNA, 2525 bp, Homo sapiens
  Payload ID: 18824
  Gene Name: UBA domain containing 2
  Uniprot ID: Q8NBM4
  ENST ID: ENST00000376440
  CDS Start-End: 504-1433
atgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttaggcttgggggaccgaactaactccccccgcccccacttgcaaagttcagcctccgctttagaagctgacctctcagtttcacttggatgtgtttcttcttcagtctccaagaagagtttttagacaaacacacactgatgagagtgctttcaagtggagggaagttaggaagtcgtggcgagggagcgcagctgtgctgctggatgttgctgttttcctggcgtgttagcggtggtcagcagacaaggcgcctctgtcgaagagccttctgctggtccccagtgccctctccctcctgctcgccctcctcctgcctcactgccagaagctctttgtgtatgaccttcacgcagtcaagaacgacttccagcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttt

SEQ ID NO: 196853 - DNA, 1375 bp, Homo sapiens
  Payload ID: 18824
  Gene Name: UBA domain containing 2
  Uniprot ID: Q8NBM4
  ENST ID: ENST00000403766
  CDS Start-End: 136-1170
ccgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttc

SEQ ID NO: 196854 - DNA, 627 bp, Homo sapiens
  Payload ID: 18824
  Gene Name: UBA domain containing 2
  ENST ID: ENST00000457666
  CDS Start-End: 221-627
ccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccagacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggatt

SEQ ID NO: 196855 - DNA, 853 bp, Homo sapiens
  Payload ID: 18824
  Gene Name: UBA domain containing 2
  ENST ID: ENST00000474510
  CDS Start-End: 1-132
ggaggaatgatcaattggaatcgtctttttcctcctttacgtcagcgacaaaacgtaaactatcagggcggtcggcagtctgagccagcagcgccccctctagaagtttctgaggaacagaccaatgaatgactgcaagcccatgaagccaacactgacgaagttgcagtatgcagcgccgtgcctcgcctcgcctcgcctcaccattgcctccactcacgccagaacaagtgtctatcctagcacagtcttttccagagtctcagtgtcctaccagcattctcattttgtcctccacatgtttattggtcacttttgatcttcacattcagccttctctaactggtgctgggcaccgggtgtgtcaggctctgtgttggggggaagcaagccaggcctggtgccagccctcaagggagctcaccgtctatgagggagaccagatccatgcaaggccctaacccagtacccaactcatgcaagtacctagtgccagtccttagagcagaggagacctgtaaacattcattcctgtactttaacaacttgacatcaggagattttacattgaaactttctcttcctgtggatgttagatcggatcaggtgctcatggtgagttctgatgcttctcatcccagtagctggactacagagacaggaagcagcctgcagagaaaatgaagtagtccagggtttcagtgtgagttaatgtgtgttgtggctaaaatgtggtgctttcgatagggagagagatgggctgaccatctataataccattatttatatagtcatcagagttgtgtatttgctaaactttataaatacataaagtgtattttagaacaacaca

SEQ ID NO: 196856 - DNA, 1413 bp, Homo sapiens
  Payload ID: 18825
  Gene Name: UBA-like domain containing 1
  Uniprot ID: Q8TB05
  ENST ID: ENST00000283474
  CDS Start-End: 130-663
gcgaggcgcggtgagtcagagccgcacagtaaatatttgtattagccggagccggctcgctaatggtggacgcgtgaggcggaggcgcgggcggaggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccac

SEQ ID NO: 196857 - DNA, 1275 bp, Homo sapiens
  Payload ID: 18825
  Gene Name: UBA-like domain containing 1
  ENST ID: ENST00000591897
  CDS Start-End: 172-525
cgggcttcgcgtcccctagggtgccggccccgctcccccggggcgcccggcgcaccgtggggactacatatcccagcatgccgcggcgccggcggagcgaggcgaggcgcgacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccac

SEQ ID NO: 196858 - DNA, 281 bp, Homo sapiens
  Payload ID: 18825
  Gene Name: UBA-like domain containing 1
  ENST ID: ENST00000588691
  CDS Start-End: 80-281
gccggctcgctaatggtggacgcgtgaggcggaggcgcgggcggaggagggaggccggagcgggcagcgcggcggcgccatgtccgtgaacatggacgagctcaagcaccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaacca

SEQ ID NO: 196859 - DNA, 2641 bp, Homo sapiens
  Payload ID: 18825
  Gene Name: UBA-like domain containing 1
  Uniprot ID: Q8TB05
  ENST ID: ENST00000590891
  CDS Start-End: 1253-1891
tgacagtccacggccccgctgggatggagccctgctgggtgcccgcaccgtgctcagtgtggcatgcggcccgggtgtggagggagacggtggagcatcccgtgcctagcgtggtgccagccaagggcgggtggctggggagctgtgctgggagctgtcgtaaacccgtggtggctttgatcctagggccgtctttctgctccacttcccgggcactgttccgagggaggctcaggtggggaagcgagtgagcctaaagcccaggcttgtctccttggtgccaggccctgcttgctggaatctggtgatcttaggaggtcactgttgcaagggaggggacccaggagccacctagtcgaacctctttgtggtacagatggagaaaccaaggcccaaacagtggcccccttgatcagccagaagcagagctgggtggggcagcaggggatccccaccaccaggctcagactccttcaggatgcttttgcttcgcagatgaggagaccgaggcttagagaagagtagagacttgctacccgttgaggtggtaacagccaggctagaatctcctgaaacggggcagggtggggaggtctggttgggctacctggggccgggcgcctttcccccaggatggggtgtactgcccgccctcccccagtcatggtgctggtgccagctggtgcagggggagggctctgcaggccttaggcactgaggcaggtggcgagcagcaggggaagggtcttctccacccaccccaactgcccaaggttccgtggctcctccttagacagcagtgagggttgggggtgacaggcaagccactgagcctcagcaccgcgactcacccctcccactcagcagtccagccagggtcatccccagcctcagaggagcctgggaacaagggcagcggcagggccggcgggggcctggagggtgagcaggggcctttcttcctgcagacagccctcagcgcctttttccaggagaccaacatcccctacagccaccatcaccaccagatggtaagtgtccccggagtccccagttctggattgggcggaaggaggccgagctagttctgtgtataagcagcccctggccccggtgtacgagggcgctggtgcaggcggggctcgacctctttggagatgggtcagcaggagtcccggctccgtgggtcctgcacttaatcttgcctgtgccagctccccctgagacctggggggcgctggcctctggggcaatgaagctccttaccctacagcccccggggatgctgtggctgatggaaaggggtgggctgggaaagcctcgtggccccaggcaccgtgggctcctgagagtgaggctgggtcggttcatctcaaggcttctcctctgggaacccctgggcggcggacaggcttggggatctggggaaggaacacagagccttccgagaatgggccagccacgcatctccccttgggaggcagtgggggcccctccaggaaggggtgctcaccccatctctcctctcttcccctcacagatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccac

SEQ ID NO: 196860 - DNA, 707 bp, Homo sapiens
  Payload ID: 18825
  Gene Name: UBA-like domain containing 1
  ENST ID: ENST00000587649
  CDS Start-End: 77-445
ggctcgctaatggtggacgcgtgaggcggaggcgcgggcggaggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgaggtgcgcggcgccggagccgggcgagggccggggccacgggcggagtgtgtcccgcgtggccgccgggcgggggcggacggcgtggacgcgtgccggctgtgcgccccctccgggccgcagacccgacccgctttcccgacggcggtgcccggcgtccggatcccaagggctcgcggcgggcggagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacaccccc

SEQ ID NO: 196861 - DNA, 659 bp, Homo sapiens
  Payload ID: 18825
  Gene Name: UBA-like domain containing 1
  ENST ID: ENST00000591113
  CDS Start-End: 504-659
gtccgggtaacggccgagggccgggcggccccgcggtgcagacggacagtcgggcgggcggccggaaggaggacgccccaggcctcggcagagctgggccggagggcggagccgctccgggcgagtggtccgagggtccgcgtgcctggtgggcggtcggcggcgtgcgcacacgtccatgtgcatttgtgtttacgcacgcaccgcgccacggcgtcggccgggcaccggggaggtggcggacctgcgggcacgttggcgcgcgtgtgaacgcgcagccccctggtgcgtttggtgtgtgatcaacgcgtacacatgtggcgggtgtgcagatgccgcccgtgcccggcacggtgtgatgtgtgtacacggcctggagtgtaggggtggcgtgtcggagccccacactacaccacagggatgagcgtgtatccccttcagagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccc

SEQ ID NO: 196862 - DNA, 1462 bp, Homo sapiens
  Payload ID: 18825
  Gene Name: UBA-like domain containing 1
  ENST ID: ENST00000590965
  CDS Start-End: 78-362
cggctcgctaatggtggacgcgtgaggcggaggcgcgggcggaggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagtccagccagggtcatccccagcctcagaggagcctgggaacaagggcagcggcagggccggcgggggcctggagggtgagcaggggcctttcttcctgcagacagccctcagcgcctttttccaggagaccaacatcccctacagccaccatcaccaccagatgatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccac

SEQ ID NO: 196863 - DNA, 799 bp, Homo sapiens
  Payload ID: 18825
  Gene Name: UBA-like domain containing 1
  ENST ID: ENST00000587615
  CDS Start-End: 76-534
gctcgctaatggtggacgcgtgaggcggaggcgcgggcggaggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagacagccctcagcgcctttttccaggagaccaacatcccctacagccaccatcaccaccagatggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccac

SEQ ID NO: 196864 - DNA, 1305 bp, Homo sapiens
  Payload ID: 18825
  Gene Name: UBA-like domain containing 1
  ENST ID: ENST00000591401
  CDS Start-End: 85-555
ccggagccggctcgctaatggtggacgcgtgaggcggaggcgcgggcggaggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgagatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccac

SEQ ID NO: 196865 - DNA, 1593 bp, Homo sapiens
  Payload ID: 18826
  Gene Name: UBA-like domain containing 2
  Uniprot ID: Q8IYN6
  ENST ID: ENST00000327490
  CDS Start-End: 305-799
aggattcgaatcgaacgtccttacgggagccgggcgctggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagttgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcc

SEQ ID NO: 196866 - DNA, 660 bp, Homo sapiens
  Payload ID: 18826
  Gene Name: UBA-like domain containing 2
  ENST ID: ENST00000589240
  CDS Start-End: 265-579
gttgtcggcccggaaggcgatcggcgcccgcgagcgggtcttacgcgggaccggggccgggaccggctcccctctgcacgtggggcagccgagggtcgggggccgcgggccgggcgcggaggcggggagagccggtggggggcccagccgctgcgtttcctgactccgcctggcccgccgtgtcactgccctgtttgtccgcagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggag

SEQ ID NO: 196867 - DNA, 286 bp, Homo sapiens
  Payload ID: 18826
  Gene Name: UBA-like domain containing 2
  ENST ID: ENST00000587913
  CDS Start-End: 94-286
ggcggagcgggcggcggagcggcggcagcagcgaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctgga

SEQ ID NO: 196868 - DNA, 951 bp, Homo sapiens
  Payload ID: 18827
  Gene Name: UBE2F-SCLY readthrough (NMD candidate)
  ENST ID: ENST00000449191
  CDS Start-End: 75-470
cccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtggatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagagcttatgtcagggccagatggaaatgacagtgcctactccaagagttccccatgctgggaaagagaacacctgtgaacagggcctccatgcacagccaactggggtgagaattctatttggtgcacgtgctattgtgtccggaattggtgggttcttggtctcactgacttcaagaatgaagccgcggaccctcgcggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgaggtaaa

SEQ ID NO: 196869 - DNA, 2902 bp, Homo sapiens
  Payload ID: 18827
  Gene Name: UBE2F-SCLY readthrough (NMD candidate)
  ENST ID: ENST00000449891
  CDS Start-End: 136-357
acttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggtgagaattctatttggtgcacgtgctattgtgtccggaattggtgggttcttggtctcactgacttcaagaatgaagccgcggaccctcgcggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacataggaccgcccacataggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattattaactcagggtttcagctccaacctcgctgagttggtgcagctccaggtcattcctggggtgggaatcggatcatccctgactcagcttttaccttaattttatttgcagaggattcttttctcaaaatgctctggcatttggacacacatcacatgtcgatatttgcataggagtcattttcagtggaataacatttttaatgtgtggttttacggttcaaggaactacttgatgattttgaggaaacacttgccagaaactaaattaacgaataaaagatttcagtgcccg

SEQ ID NO: 196870 - DNA, 825 bp, Homo sapiens
  Payload ID: 18828
  Gene Name: UbiA prenyltransferase domain containing 1
  Uniprot ID: Q9Y5Z9
  ENST ID: ENST00000376804
  CDS Start-End: 5-544
ttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggagtcctcatctagccactgaagcagagtgcccacatcaggagcagccagtgctcaagctcccagaaactgcctagtgacctgccttctagacctgcctcctgagaatggggctggccaccttcgaggagagggaagtgagccccttcctgcctcggggtgggcagcatctggagctgacaattgtatgcatgttcaggacacaggatactcaactcttcgggttcagtgtgctgtgtggagggagaggaagttgacacacgtgaaccatagaataaacaacgaccacagaacat

SEQ ID NO: 196871 - DNA, 3646 bp, Homo sapiens
  Payload ID: 18828
  Gene Name: UbiA prenyltransferase domain containing 1
  Uniprot ID: Q9Y5Z9
  ENST ID: ENST00000376810
  CDS Start-End: 327-1343
gcgggcctccagaggccggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgttttttgttttttccattttatggggaatttaaaaaccattcttgtatcagaaggtgaattaggcgcatggtctttgttttattaataatttccactagagggtgttctcaggtcactttgcagtgaagtggacttagttcctccttgttctgtacaaaatgtctccagactttgtaaaggagctgcccagtttggcctcctgtcccgaaaagaccctaataactaggcagagtgttgtcctgctttcttcgtctcgtaggatgtgctatgattggtgccaggcctcactaacacaggggctacctgtctcttattctcagcacctgtgtcctgagatacgctgcctgagacagagagagtccctcattaacagcctgtgtggctgtcagctttttgcctaaattgtgattcagatgcttttgttctctctcctttcacttattgccacagttgaggaaaagtgtcagattaccctgcagcaagacaagccaaggactgggagggaaaaaaaaaccactctggaggcaactgagaaaatcactgcttttggataggaatcagtagggtggctgttttccctttgttgaatctactagagtgacaggaaggactcccagccctttcagtaactatcaggagccctgaaacggtagaggcactgccatccttgtgggatactcaaagcccacagggcttttccctccctattgcatcttctgatgctccccacacctaccctccacctctccacctctgtggtgttcccatttgtgtgtttcccatctgtggagccagactgagcaatagcttagcagcgagtcagggacagctgccactttccacagagccacaggatgggcagagcagggacccagggaatgaatagccagtggacaaacagtcttgagctctgttcagccagagtgatgggccctgccagttaaggggctgtgtcttcatccttgaagacagatgtgcaatattgaccctgcctctccccagggctttgtggaaagatagttgagggctttagtgagatcacactcagagtggggcaattccagcatttatcctggctgcgtttcattgcattgtctgtgaagtataatttctgggccagaattgctcagttgcatttgatccaggactatagattggaaatgggtcatcattgttttctgttgtgattatagccattctagtaggcgtttaaggtcatggcctgcagaaaatgatgtaagaactagttcttaatctttcagatcaagctaatgatgatatggaaccttgagttcgaattgattggtttacttggaaaaaaacatgtttgaaaattgcaaaagttccgccgggcgcggtggctcatgcctgtaatcccagcactttgggaggccgagacgggcggatcacgaggtcaggagatcgagaccatcttggctaacacggtgaaaccccgtttctactaaaaatacaaaaaattagccaggcgtgttggcgggcgcctgtagtcccagctacctgggcggctgaggcaggagcatggcgtgaacccaggaggcggagcttgcagtgagctgagatcatgccactgcactccaacctgggggacacagcaagactccgtctcaaaaaaaaaaaaagaaaaagaaaattgcaaaagttcctctaaagttaaatcaaaggtggtttgtctagcagagagccagaatcttctaatagtgggcagagcccagagacaaggggaagaaagatgaccttctccccagtccttcccagcaccatttttgtttcacaccaggcttgtggcattttggtgctcacaggggttttgccttctgacctctccttggagtaggccattctcatgcagggctcaccctgaggcaggaggaccaagggctccctgcgtccacggaccacgtatgccttggtggtcactcccatcggggctatcagttctgcactgtgccctggtgcggattttaatgcatatttttatatataaatgttcccaaaggccaaatttgttgccaggttttatacgcaggtcaccataatttgtattatgttccctgagtcaatgaaggttttctttagacttcttaattaaaaagagaagaaagaaaatgttca

SEQ ID NO: 196872 - DNA, 1393 bp, Homo sapiens
  Payload ID: 18828
  Gene Name: UbiA prenyltransferase domain containing 1
  ENST ID: ENST00000483738
  CDS Start-End: 1-234
ggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccagtcctcatctagccactgaagcagagtgcccacatcaggagcagccagtgctcaagctcccagaaactgcctagtgacctgccttctagacctgcctcctgagaatggggctggccaccttcgaggagagggaagtgagccccttcctgcctcggggtgggcagcatctggagctgacaattgtatgcatgttcaggacacaggatactcaactcttcgggttcagtgtgctgtgtggagggagaggaagttgacacacgtgaaccatagaataaacaacgaccacagaacatcaaggtagagatggggctgctgggtatcaggaaggcttccaggaagaggtgacaatgagcggcgatcaaggtttctaggaagaggtggccataagaggtgactgttccatggaaaccgaggtgctgatggacagctcaattcccccagctggagaaagcccccctgttgctgcctgagagagtaagactcgaagttttccttaatcagcctcttttggctgtgcagttagacaactggagcattgaggcaggtgtgccaagggcactctgaccactgccaaggtcaaagccttctgcagaatgaaaactccgacacttccttgctgagaaacaaacaagagagaatggcggggcatttaatcatccacagctgccaatacctaatcaagatgaatggcctggagagacaaggccagggaaagcatcccgtgaagcaggagcgctgagcccaagtctcctgcgagtcaggggagcccctcagccctgggccacattgaggccaagggaataccaggtgggaggccctcagattcaggggaagtgctgagggggtcagaggtcaccatggtcaccaatgagggccttccagctgacacttgccttggccaaagacctttactgagagcctgctctgtcccaggaggcaagataaacgaggcacacccctgccctttgaggacacacagtgaactaatagcaaaagctacatgcatacattatcctgccacctcaagtgtcaacatagacacttgtccctagagatccttaaagcccctctgaaggacaggccactcacagccatgtgtgagacatagaggcataaaggctgtggggaaatgagggcagaagagatgaacttctccatgccccattgttccagactgc

SEQ ID NO: 196873 - DNA, 831 bp, Homo sapiens
  Payload ID: 18828
  Gene Name: UbiA prenyltransferase domain containing 1
  ENST ID: ENST00000486588
  CDS Start-End: 1-357
acacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggctggagtgcaatggtgcaatctcagctcgctgcaacctctgcctccagggttcaagcgattctcctgcctcagcctcctgagtagctgggattaacagcccatctcagcactagcacagtgcatggtgcaacagagcaggcagtcagtaactggttgttgaatgactgagttacatgggaagggctgggccctccagggctgactgacaggtgtgagagtttggaccactgcatcacatcagctgtcagtaaggacagtcctcatctagccactgaagcagagtgcccacatcaggagcagccagtgctcaagctcccagaaactgcctagtgacctgccttctagacctgcctcctgagaatggggctggccaccttcgaggagagggaagtgagccccttcctgcctcggggtgggcagcatctggagctgacaattgtatgcatgttcaggacacaggatactcaactcttcgggttcagtgtgctgtgtggagggagaggaagttgacacacgtgaaccatagaataaacaacgaccacagaacatcaaggtagagatggggctg

SEQ ID NO: 196874 - DNA, 6252 bp, Homo sapiens
  Payload ID: 18829
  Gene Name: ubinuclein 1
  Uniprot ID: Q9NPG3
  ENST ID: ENST00000262376
  CDS Start-End: 620-4024
ctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaa

SEQ ID NO: 196875 - DNA, 6336 bp, Homo sapiens
  Payload ID: 18829
  Gene Name: ubinuclein 1
  Uniprot ID: Q9NPG3
  ENST ID: ENST00000396658
  CDS Start-End: 704-4108
ttctgtgaacatttggaattctgtattcaaaatctattttgaccattcccaagtgattttgaaggtctttggcatgtcataatttgttattttgtcaaggccagtgtttgggtgtgagagtggtgcacagggcaggagtgtgtaactttgttaggaagtgagcctagccacaccctcctgagtcactggttctttactatcctggggtaggcaatatcttttgttcagctgataaaagctttgtcattgtgaagattggctcccaatgataggaaactgctggtgatgaaaataaaggggtcttaaagattattctcagccagaaaaaataagtgttagacaaattaaatggaaaataattaatattttagtagtctttacaatttggaggtctaaggctctgtcagcatgggttctttaaggtcaaggatctaggatacacatgcacaggaaaaaagactggaagtatgctaagcagtgactatctctgaatgattgtgaaaaaattttaggatgaataagcagaaaaaaacaataaatgacaaaatataacaatggagttttcttgacaatgaaattctcttaaacttaaatctctttaattaggcaggtaaactattttatcatcttcgtttgacctggcccttcttttcaatgttaacagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaa

SEQ ID NO: 196876 - DNA, 937 bp, Homo sapiens
  Payload ID: 18829
  Gene Name: ubinuclein 1
  ENST ID: ENST00000586716
  CDS Start-End: 1-937
gttcggatgaggaagaagatgaagaaaaagggggcaggaggataatgggacctcggaagaagttccaatggaatgatgagatcagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccaggg

SEQ ID NO: 196877 - DNA, 2305 bp, Homo sapiens
  Payload ID: 18829
  Gene Name: ubinuclein 1
  ENST ID: ENST00000592120
  CDS Start-End: 1769-2305
gcagaccgcgggaggcacccaagcgtgcactggtcactgccaagccatcggttgtaaaggagaagtccccccgccgtttcttcgcggggcaacgccagcagtccggtttagacaaccccggctgagccggccgcacaggtcggctgcatcgcaacctgggctttgaccgaatggcaccggccagatctcgcaggtccggtccccggcgcttctgctttctgggaagccccaacaagaccccggggaccggtcgtccggggaagcctcgcggcaccggcggctcccttcacgggggccgccagtatctgggccccgagtgcagaccccacccggccggcctcggggatcaaagccggtgcccgacgtggccaccctcggcctcggtcccccgggactggactgccccttccgcctggcgccgctcgcaagcgccggcaccttctcttcccctctctccgcgacctggagcgcataaaaaggcagctccagggccggcagcgaaccccgcgcccaggcgggtagctccccggcgcgtctcggttggcccggccgctcggactcaccacaccaagtcgccgagccgcagactcacagccgccatcttaccacccaaccaccgccgacgcacgggccgccgggaacagcaagtcgccccggcgccgcccattggagtgggcccgaccacgtgacgggggccggctgtcactggccacgccgctactctgacgtcaccgcgcccgccggggatcattggtcgaccgaggggcacgtgacgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaaggtgcgtgtcgttgtcgggtccgggctctctcgttagccttgccctagttttgcacttttgaaaaagttgtgacaacaggaagacagatgccgggcgtagtttggacactttaaaactgaaccatgaactgggaagtgttaactgcagttgagcgcagcgtcggcccaaacttcagcagaccagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttc

SEQ ID NO: 196878 - DNA, 837 bp, Homo sapiens
  Payload ID: 18829
  Gene Name: ubinuclein 1
  ENST ID: ENST00000587027
  CDS Start-End: 1-216
aagaaacgtagaaaagaccgaatacaggacttgatcgatatggggtatggttatgatgaatccgactccttcatcgataactctgaggcgctcagacattcatgtttgaccagaggatgttttagcatgctcttggaagtggcagaggagcacagtcacatctctctcgagacccactttgcaccttcggactgcagaagcagaacttggagctgacagtttgtttcccatcttcagtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagctgccagagctgctgagggggagagcagacagaagttcttcacccaggatattaatggaatcctattaga

SEQ ID NO: 196879 - DNA, 3530 bp, Homo sapiens
  Payload ID: 18829
  Gene Name: ubinuclein 1
  Uniprot ID: Q9NPG3
  ENST ID: ENST00000590769
  CDS Start-End: 54-3368
cttcagcagaccagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaagatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccat

SEQ ID NO: 196880 - DNA, 705 bp, Homo sapiens
  Payload ID: 18829
  Gene Name: ubinuclein 1
  ENST ID: ENST00000589191
  CDS Start-End: 1-169
agggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcacgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctgg

SEQ ID NO: 196881 - DNA, 2897 bp, Homo sapiens
  Payload ID: 18830
  Gene Name: ubinuclein 2
  ENST ID: ENST00000483726
  CDS Start-End: 1-1334
caaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccgtgagtaaatgcagactccagattgcttcatttattcacattatgtgctttagtgaacaaaagtatcatttattaaatgctagttggaataggacttaaaaagatcattttgaccattgactatttagacttcagaacacatttatctattgaaataattgtcagggtactctctaaacacctactaaatccacactgtgacacataatggcctgggattctggtagtagggaagcatgaaggctcagggattttcctttgttcctgggccttctacctgccagtctttttctccacctcttaatgtccatctgcatttgtaatctacagccctctgtgtcctgagtttaccaggacagatccatatgcacacccaccctcgctgcactgcagagtgttttattccacaaaattaacctattcttgaggtcttctgttcaaaaccgtgtatttccttagtgatgtgattactagagaaagatcttttatcccctccacatacaacaaaaaggcaagttttttctgtggtcacctttttggttgaatattggtcaattccagaacagtttcatttttccctacaacgtagggctacttctctgtagcctgcaagggtggcattaacggttattaaagccaggcacagtggctcgcgcctgtaatcccagcactttgggaggctgaggcgggtggatcgcttgagcccaggagtttgagactggcccgggcaacatggcgaaactccatctctacaaaaactataaaaattagccaggcatggtgtgtgtgcctgtagtcccagctactcaggaggctgaggtgggaggatggcttatgccagagaggcggaggttgtagtaagtggagatcatgccaccgccctccagcctgggggacagaacagaccttgtttccagaaaaaaaaaaggggggggttattaaaatataaaattagcaagttactgagaatttactgaacactctaattcaatattctgctgagaggtctgtttaatatcttttgggcaacattataaaattcctactctccttgtatgcagttatataggaattttttagtttttaggaaggacagttcattattacggttgacccttggaacaacacgggagttagggatttcaccccctcatcccacacagtcagaaatccatgtgtaactttcagctctcccagaacttcactgctagtagtctactgttgacctgaagccttactgataacataaatagttcatgaacacattttatatgttttatgtacagtatactgtattcttacaataaagtaagctaaagaaaagaaaatgttaagaaaatcataaggaagagaaattatatttactattcattaggttgaagtgaatcatcataaaggtcttcatcctcaggggtcaactgtatatcagagatgcattgagttggttgtggtttttggttctgttttttttagtataaattctaagttgtttggtttcatatattacaggtttactttgttgcaagagtttttgttgtctttgaaataaattttatgtacatacgta

SEQ ID NO: 196882 - DNA, 589 bp, Homo sapiens
  Payload ID: 18830
  Gene Name: ubinuclein 2
  ENST ID: ENST00000486663
  CDS Start-End: 177-589
gattcccttcaggatgtgaagggcgagccctcaaatttactttttattcaatggattaaaatggccagtaattcttatccttttaaacccgacttccaattaattaattacaaaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaa

SEQ ID NO: 196883 - DNA, 14444 bp, Homo sapiens
  Payload ID: 18830
  Gene Name: ubinuclein 2
  Uniprot ID: Q6ZU65
  ENST ID: ENST00000473989
  CDS Start-End: 1-4044
atggcggagccgcgcagagtagcgttcattagcttgtcaccggtgcggcggcgcgaggccgagtacccggggcccgagcgtgagcccgagtacccccgcgagcccccccggctggagccgcagccgtaccgcgagccggcccgggcggagccgccggccccgcgggagcctgccccccgctcggacgcgcagcccccgtcgcgggagaagccgctcccccagcgcgaggtcagccgcgccgagccgcccatgtcgctgcagcgggagcccccgcggcccgagccgccgccgccgttcccgccgctgcccttgcagccgcccccgccgcgggagtcggcttcccgggctgagcagccgccgcggccgccgagggagacggtgcgcctggagctggtgcttaaggaccccaccgacgagagctgcgtggagttcagttacccggagctgctgctgtgcggagaacaacggaagaagctcattcacacagaagacccatttaatgatgaacatcaggagaggcaagaggtggaaatgttggctaagaagtttgaaatgaaatatggtgggaaaccccgtaaacaccggaaggatcggctacaagatttaattgatataggctttggctatgatgagacagatccatttattgataactcagaggcttatgatgaattagttcccgcttctctaacaacaaaatatggaggcttttatatcaacactggcactctacagtttcgccaagcttcagatactgaagaagatgatattacagacaaccaaaagcacaagccacccaaggtccccaaaataaaagaagatgatattgagatgaagaagcggaagcggaaagaggaaggggaaaaggagaagaagccaaggaaaaaagttcccaaacaactgggagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagctgccaaactttttgatgaagaaggaaggaaaaaattctttacacaggatatgaataatattcttctggacattgagttacagctacaagaactaggccctgtcattcgcagtggtgtctactcccaccttgaagcttttgtgccatgcaataaagaaacactagtaaaacgtctgaagaagttacatctcaatgtccaggatgatcgtttaagagaacctctgcaaaaactgaaactggctgttagcaatgtcatgcctgaacagctatttaaataccaggaggactgccaggctcgtagtcaagctaagtgtgccaaattgcagacagatgaagaacgagaaaaaaatggatctgaagaggatgatgatgagaaaccaggaaaacgtgtcataggaccaagaaagaaattccactgggatgacactatcagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaagaatgctttttaaggaaagccggagtgttcataatcatcttacttctgctccggcaaagaaaaaggtgattcctgcacctaaacccaaagtaaaggaggtgatggtaaagacccttcctctccattctttccccactatgcttaaggagtgtagtccaaaaaaggaccagaaaactccaacatccctggtggcttcggttagcggtcctccaacgagctccagcacagctgccattgctgcagctagctctagctctgcaccagcccaagaaaccatctgcctcgacgactcactagatgaagacctttctttccattcaccttcactggatcttgtttctgaagctttagcggttatcaacaatgggaacaagggccctccagttggctcaaggataagcatgccaaccacaaagcctcgtccaggactgagagaagaaaaattagcaagtatcatgagtaagctgccactagctactcccaaaaaactagattctactcagactacacattcttcaagtcttattgctggtcacacagggccagtaccaaagaaaccccaggatttagctcatactggcatctcttcaggccttattgctggttcttccattcagaaccctaaagtttctttagaacctttgccagccaggctacttcaacaaggacttcagaggtcaagccagattcacacttcttcctcttcacagacccatgtctcctcttcttcccaagcccaaattgctgcctcttctcatgctctgggaacatccgaggcccaagatgcttcttcgttaacacaagtaacaaaggtgcaccagcattcagctgtccagcagaactatgtgtctccattacaggccaccatcagtaaatcccagaccaaccccgtcgtgaagttaagtaataatccccaactctcctgttcctcctcacttattaagacttcagataagccacttatgtaccgccttcccttatctaccccctcacctggaaatggttctcaagggtcccaccccctggtttctaggacagtacctagcaccactacctccagtaactatttagccaaggctatggtgtcacagatctccacgcagggtttcaaatctcccttctcgatggctgcctccccaaaacttgccgcatctcccaagcctgccacatctcctaaacccctgccctcgcctaagccttctgcctcacccaagccctctctgtcagctaagccttcagtatcaactaaacttatttctaaatccaacccaactcccaagcctactgtatccccaagtagttccagtccaaatgcactagttgcccagggtagccactccagcactaacagcccagtccataaacagcccagtggaatgaacatcagcagacagtctcccaccttgaatttattgccctctagtcgcacttcaggccttccacctacaaaaaatcttcaggccccctcaaagctaacaaactcatcatccactggaactgttgggaagaacagcttgagtggaattgcaatgaatgtacctgccagcagaggtagcaaccttaactcaagcggagctaataggactagtctgtctgggggaacaggaagtggaacacagggtgctaccaaaccattgtctactccacatagaccatccactgcctcagggtcttcagtggtaacagccagtgtgcagtccacagcaggagcatcattattggctaatgcctcacctctgactctcatgacatcacctttgtctgtaacaaatcaaaatgtgactccttttgggatgctgggtggccttgttccagtgaccatgcccttccagtttcccttggagatatttggctttggaacggacacagctggagtgacaaccacctcgggatctacctcagccgctttccaccatagcctaactcagaatttactaaagggtttacagccaggaggagctcagcatgcagcaacgctttcccactcacctctgcctgcacacttacagcaagcatttcacgatggaggccaaagtaaaggggacactaaattaccacggaaatctcagtgactgcccagcaagcaaaggagacgaaatgtttagttgactgatggaatctacctgatgggaaagtacttatgtggtcatagggctgctgtttctgtcgatgtttacattctctcgtcccaagcactgtggtgaggaggaaaaagaaaagaaaacattacttgagcaaagccaggtgcaggaggaagaaatgcttttgtgcaaagttagtgacctttggtctcttctaaagaatgacagagttaccgtattaacagacttgaaagagactcagttgtcaaacccacagaaatacaaatttgatttttcccgggggaggaagaaggaagtgaagagaatttgggtaaactccatccatcctgggggttggatctgaacacttacagacataattggtaataaaaggcattaaaaactggaattaggccagtttgtcaggaataatgatcatgtctatttgaatggactgtgtagcagatttgccacaaaaagaaataataatgattctatctccgatagacagtagctgcatagcacaccctcgaaaatcctgaacaaacttgaatctcctccagtgtgtagcaacttccctcaatcagtggactaaagatccttcaggaaagttattttagcacagtgatatatattattaaatcatctagatttttaaaaatcaggaagttgagcctgttgctcttaagagatgaaacctagatgtcccctttttgtaaaagggtcaatttcatcttccgttcagaagcaggtacttaactcttttcttcaggtgatttgtgcatctagtattgactggttaattcttatttccattcttgatgttaaaatgtgactgtgttcacatttttctcctgagaaatggggatctttacagggttattgctttgctgcttttagcccttgcagcaacataaactctaagtttccccagttcatctaacttcacaacttctccttctgttcttttagctagtggtccttcaggtgattattagctattggtataaacaggtagaagtgtacactatgtttcttcattggtcattcaaatggcatgaatatagtttttgaatttttaagatggtattttaaagggaggaatcacattaggatcacaatcacgacatatttttactccctgtatccagtgtagtgaaattgtttggagcatttgagatcctaaagcttcactatttactcagtgtattggtatgtgagtaaatctgcagaaaataagactccttagttattatagcttccttatgcaaatagcatattcaacaaaggatgttaagggaaaaatttatggttctccttggatacatttgatttgatgggtttttttgccgcattattctagttttttaagcttctgaatattttcatactatatcagagaatggtgtaaactctaaatggtataagcttcatccatttataatgacactaacctaaaaaaaatagactggtagtgacaagatttattgcatatgtgtttattatacattaccctataccattagatttactcaattaagagtattaaccaggcccttttttcttttatacacaaaagtcccagataccctacaggactgtgaataaataaccacagatcggttcagatctgtatgcctatattttgacttcaaagtcacattggcttgcttcatagcgaaaaagttaataaataactgaaaactttagttccaagaacttgttacagtaaagggaaaggattatttcaaaggaatcactgatataatttcttgactctaagaatttagtttatcaataaaacaaatatggatgtagtatgaaccccagtagatattttggaaggatactgggaggatgttgcagagaggtttgacttgaattcagtatgtttgatgaagatttgcttggtttcaattaaggaagcttgcccaatttttttaattttttcaaatgtagtggacctcttgcttttacgaaatatgaataaaaaggtctttgcttcatactaggggaagtgatgggattttcctttgggaaggtagcctttgttttacttctcataccacaagagaagtcgaagtgcgtattaatttctcttcctgaatacttgtatatatgtttgtctgtatgtatatatacatacacacatacattcatataaatgactagtttgagtcaaaaaatcatttgaatttcttaaaaccatcaattctgaatcatgccatatgaagatccctggtgactgtcatcattagaaaagaacaagataatcagttcttttccctgtaacattttatactaaccagtaaaaatatctgaaggcccttggctccaagaatacaatgtggagattcttctgtgttctctttagtcttgattccttgaggactactgtcagatccctaccttaaacccccacctgcactgacgacttacattcatttcagtcaggaccccccttttatgttgtatgaatcagtcaaacatcgttgtatttctgtatagataaagtatgatcagagagtttctacatgtaaatagtaatctatttctttcctagatcataacattgaaaaaggtgcccatactttatggtcacctgtctttaccgtttttattactaaaaacaaacatataaattggttattttttagcacagagacttgtgactcatactgtatttttgcacttaaaaatcaaattatgttattttttaaaatggtgagtcattggaaaggatatctatagagcaacgtgtatttctgaagagcattagcaacatccaaatgcaaaaataatcagcacacatgattatatcccactccttgggattcttgattcaggaagattaagctgtttgttttcaactgttttatattttaaattgccttcactgatatataagctgttactgtacatacaagttaatcctcagtattcacaagcaataacagtcagcagggttgtcctcggagatagctgtgctgagcctcagttggagactgggagcaaagtgtcaagctcattcagagcatccagaataaatgcaagcaataatttccattataattcaattataattcttgtatgcttttgaggtcagagggtaaatgaaatcgtgattttaaaacagcctgaagaaaaaggttttgggaaaggaaatgaggctaatctgtagtcataaaattctgatactttgcggaaattagaagatggtgatagtgcattcttttgtgcccaccccccctctgatggatgttgttagcccaaattacatttttcatatcatggacattgaatagggtttattgaatcaggaaggtaaggggaagaaccgggcacatatgtgttggaatactgtgggtttgacacctggttgaaaacaacttattggacatgatttttaacccaggatatttttttcccaaagcagatctaaattgtttactacccagggttggaaagggcaggcacctctaatctagtctttgtcctctggttgccctctcccacacccctttccacctatacttggttcaagacattttctgaaacgaaaattctgctgttgttcaaactgccattggttatgagaactctgcgtcctttgggatcatctcttagaactccagtgatctatcatatttgctgctacatttgtaaaatgaactttgcctgtattggttgactttaatttacagttctttatttctaggatgttttgtcctctagtttgactcatgtatagaattaggatactttattttaggagtgtaccgtaaaagcacactggtccctttgttgtttttattatttaggtttggaatttgtttgctttttttttgtttgttttttgttttgtttctgtttttgtttttttttaaagttggaaatagaagaatgagaaaaatctataatcaggccaaacttgagaactttcctgtgcttcagcactgtaattctgctgacctaatgttctcaaaagaggcacttttactttctattgtgcatgtatgattgttgttttttgcttttgagggggcttttgtgtttgtaataatgaagcagaagaaaagtgcagtagtagataaatgatcacaacatgttatgcaattttattttataaaattttaaggggaaaagtttaactctttgtaaatcatttcttagctctggtaaaatgcttatattactcctctaaaacatgctcaattcaggcctttgtctttgttaagtgccttttttctttcttttttcctctcttttgaaactgttgtcacattatcttaaagtacagactgataagtcaggggattcaggaggaagaatctcacacttgtcaacatcatgtcatgctgtgtaaccctcttcctttgctttctatgtatatggatatatgtgtaagatacatacattacatatatataaaactaggagctgctgtaccattgcatcctttccaaacactcccctttccatgtttgcaaaacttctgccttgtttattccattgcttttagttgattaaagtgggtggattagaaaagtatcttttcggccgggtgcggtggctcacgcctgtaatcccagctctttgggaggctgaggcaggtggatcacgaggtcaggagatcgagaccatcctggctaatatggtgaaaccccgtctctactaaaaatacaaaaaattagccaggcgtggtggcaggcgcctgtagtcccagctacttgggaggctgaggcaggagaatgacataaacccgggaggcggaagttgcagtgagctgagatcgcgccactgcactccagcctgggcgacagagcaagactccgtctcaaaaaaagaaaataaaagtatagaaaagtatcttttcacaagaggccaccttcgccctttgaatatctgcttgtagaagttaacaataacaacacacacacacacacacacacacacgtcagttactacaagtaaaataaacttagtgaatcattgactattcttggatataacccacttttctgtgctctttaaacttggcataagtaatataggagacagcattggaataacaagagtaccttgcaagtcacattggtaaggtgcgctagactaaacatgtgacaaggctagcgttagaaccgcagtttggtgtctaagtttagaagcaggttagcaactgtcaacatgaaaaatgtatcatattttcttctggaaaatgatttttgaagaaatcatatagctgcatatctatctgttaaaaggttaataaactcagaagtagaaagacttcagatgctgaggaaaacatataatctatagcattcttgagagattttccatttgctttttatttgctagataattacatttggcttaatctgattttatggttatttagatttctcccttgagcaaaataacataattttcagtatctaagattcatcgattttttgttgaaaacaaatagatgtgacatgttaagggagaccaagttgaaccatccctcagacccagtacaaatatacctagtaagtgcccccctttcaatacattctaattgggaagaagaagagactagtggcttaaaaggagaaagcagaagctcctggtagtgttacctgatagcagaacttaccaggcagttggaattcacgagtgttattcttgaatgactatgtctagggggaatattgtttaaccttcgtgcctcagattacccattagacaattgggtataatcatattcacctacctcccagggatatcagagactttactatttcaaaaatattttgagtttttgtaaaatgtcctatataattaaaaatagtattatcatcttcctgcagaggctaaaaaatgttttccttataatgagtataaaaagcaccctatggtttttaaatttaaaaaaatcactggaattttaatttagatacatatttgttatttaaacattatctttgaggtgggataaaatgtttagtttcaggttaacaagggagagaaataacactaagtttaagtagttttttttagccttttacggtgttactgtgatttttcgtcaaggttgtggagctaaagttagataaagttatgatgcttggttattggagttgataaatgatcctggaagttttaactgtctcacttttccatcttctcagtctaatttccttttattgcttgtttgaggacggatagctaagctttttaactttctaagaatgagtatgatgtctcattcttgcaaatcagagattgtgtactaattccattaactgtaggtgtatccagctctgcactgaaggggtgagcactacacacagtcagctggatactcttgtagccattgcacctttgtaattcatgcttcttcaacccatgaaagaggtggagccatcagctgctcaggttgtaagaaaatgggagacggaaggcaggattcactttctaactgggtcggggtggggaaggtcagggtagaaggaaacatgttttccccagctcccaggaggagacgaagatcattttatcccaccttccatccctgtatattaagtagtactactacatagaattttcccgttatcgtttaaaataatagcaacaggaaaagaaaaatggatgctgcagttttagttggggctaaatgctgagcaacgattgttggagtgtgtgtgtaaatttaaattgtagcacatattcagggtcaggaaagcaaaatgttggggatgaggaaccagtgttaccaggttcaagtgagttagtagaaagcaccaggtccaagcagacaaagcatctggttaatttccagaattggctaaggtccactgaatctctaatgatagggtgtgtgtgtgtgtgtgtgtgtgtgtgtgtgtgtctgtaagtcactttttggatttttgttgctttttccagataaggccttagtagcctctaaatatcaactatgcagataaacatactccttttttttttcacatgtccctgtcttttccattctcagataacaaatgttaagacccaaagaaataaggcataagggtttttgttgaatgtgtgtttgttcttctagggaaaattaacagaagcataaaatagagatactttgtgtgttcatctatcgtaaaatgtgaactctgtattcaaaaactatctacagatgctttcactggtgcaaagctgtagttagtatcatggaatgtctttgggttgttaatgataaaatcatcccagtgttcaattctgagagttttagattatatgacacaatgttcaggtttatagagctgaatgggtgatcaaactctaattaaaaatagctttgaatattaatgttgaattcttctttcttggtttcctttagtcttcattctttattcagagctcttaatcatattgctacactagaatatgaattgtatattaggagtctggggaggaaaggttaaattgtcttttacatcctcttctcactcactctggcaacctatcctgtgtccccatagaactgagaagtaaagccctgtgcaggcctgctttagaagactttacatcccagcagaggattcaggcagggactctcaggattttaatcagactgcctttgaataatgtgatattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcacaaaattttctacacattatttgttcccactttgctaataataatataatgattttattgtaaatctgtgttttaaatattttataacagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataaacattcctaaatatggacctgtgaatttagtaaattacccccatgaatatactccttcagtgcagggatttttgtgttttttttttttttttaatttttttgcaacagccttgctcatattccaggtgtagctagcaaacccctgtttttgaagcaagagccttatttgattcagtgtagatgtttcctgtctatcctttgtgacagggccttttaatgagtgttttttctttttgtatatgttacgtgtttgttgttgtattaaataaagaggaatgtacatacta

SEQ ID NO: 196884 - DNA, 2299 bp, Homo sapiens
  Payload ID: 18831
  Gene Name: ubiquilin 1
  Uniprot ID: Q9UMX0
  ENST ID: ENST00000257468
  CDS Start-End: 256-1941
gcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacagatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaa

SEQ ID NO: 196885 - DNA, 4118 bp, Homo sapiens
  Payload ID: 18831
  Gene Name: ubiquilin 1
  Uniprot ID: Q9UMX0
  ENST ID: ENST00000376395
  CDS Start-End: 525-2294
ggaaactgcgatttagtttttggtgaaaggagtggaaaaaaaccatgaactgacctaccccgccccattttgcttttagtccttcacactggcttcgcctgcactttgggcaatggagcgggaaaggaaaaggcacgcaggctgagctcaaagtcgcgccagccggggatgactcggcgacgccgccaggcgcgttacccggcgtgctccgcgcggcgccggcgaagggacgtgggggaaggggcagggaggaggaagcggtggctgctgcggatgtcggtgtgagcgagcggcgcctgaacacacggcggctgccgagcgcctgacccgggcctgcgccagagcctgcaccgagctccggggccccacacccgctacggtggccctgcgcccgttgctactgaggcggcgtgctctgcattcttcgctgtccaggcctgccggctctggtgtctgctggctcctccttgctcgcctgctccctcctgcttgcctgagtcaccgccgccgccgccgccacagccatggccgagagtggtgaaagcggcggtcctccgggctcccaggatagcgccgccggagccgaaggtgctggcgcccccgcggccgctgcctccgcggagcccaaaatcatgaaagtcaccgtgaagaccccgaaggaaaaggaggaattcgccgtgcccgagaatagctccgtccagcagtttaaggaagaaatctctaaacgttttaaatcacatactgaccaacttgtgttgatatttgctggaaaaattttgaaagatcaagataccttgagtcagcatggaattcatgatggacttactgttcaccttgtcattaaaacacaaaacaggcctcaggatcattcagctcagcaaacaaatacagctggaagcaatgttactacatcatcaactcctaatagtaactctacatctggttctgctactagcaacccttttggtttaggtggccttgggggacttgcaggtctgagtagcttgggtttgaatactaccaacttctctgaactacagagtcagatgcagcgacaacttttgtctaaccctgaaatgatggtccagatcatggaaaatccctttgttcagagcatgctctcaaatcctgacctgatgagacagttaattatggccaatccacaaatgcagcagttgatacagagaaatccagaaattagtcatatgttgaataatccagatataatgagacaaacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcgccaaatttggtgcctggagtaggagctagtatgttcaacacaccaggaatgcagagcttgttgcaacaaataactgaaaacccacaactgatgcaaaacatgttgtctgccccctacatgagaagcatgatgcagtcactaagccagaatcctgaccttgctgcacagatgatgctgaataatcccctatttgctggaaatcctcagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactggaacaactcagtgcaatgggatttttgaaccgtgaagcaaacttgcaagctctaatagcaacaggaggtgatatcaatgcagctattgaaaggttactgggctcccagccatcatagcagcatttctgtatcttgaaaaaatgtaatttatttttgataacggctcttaaactttaaaatacctgctttatttcattttgactcttggaattctgtgctgttataaacaaacccaatatgatgcattttaaggtggagtacagtaagatgtgtgggtttttctgtatttttcttttctggaacagtgggaattaaggctactgcatgcatcacttctgcatttattgtaattttttaaaaacatcaccttttatagttgggtgaccagattttgtcctgcatctgtccagtttatttgctttttaaacattagcctatggtagtaatttatgtagaataaaagcattaaaaagaagcaaatcatttgcactctataatttgtggtacagtattgcttattgtgactttggcatgcatttttgcaaacaatgctgtaagatttatactactgataattttgttttatttgtatacaatatagagtatgcacatttgggactgcatttctggaaacatactgcaataggctctctgagcaaaacacctgtaactaaaaaagtgaagataagaaaatactcttaaagctgagtatttcctaattgtatagaatcttacagcatctttgacaaacatctcccagcaaaagtgccggttagtcaggtttgttgaaaatacagtagaaaagctgattctggttatctctttaaggacaattaattgtacagacacataatgtaacattgtctcaacattcattcacagattgactgtaaattaccttaatctttgtgcagactgaaggaacactgtagtataccccaaagtgcatttgcctaggacttctcagcttctcccataggtagtttaacaggcattaaaatttgtaattgaaatgttgctttcactgaaaaagtgtcttgatgtttcagttatttttaatcgccataaaaaaatagaactatcttttgggtttatctgttttctcatgcacaggcaatacacaaatttaaaatgagttgtgagccaattgtttctgaagtgttttggtagttctattaagaaatagttaaatattgtgcttttcagagcctcagagaaagggggacggggtgggggggtggggcagcggaatctgtcctggatggggccagcttaaataatactggcaaccaagattctgttaggatttctgtgcatatagtgtagtaaagaagtatcattcaggggtgaaaaacaaagagccgttttaatgatgttgagtacatttggctgttttatagcctttttcttccctcccccaaagaattctgtttgcctaactcccaaactgttggggtggtacattcctttaggaccaattaaaacataattgagggtcagtgatacatttggctgactctggttcagtattctcttaggtgattatattctctcatgtacagttacaggaaattaaaatgttaaagtaacctaaaatgaattcagaccaataaaatcaagggaaatacaagttgattgcattacttctgtatgttgcttgctattaaaaaggttaagaggccaggttacccaccagtccttgcactgttctgacactttccccaggaggaaaacaagtacaaaggttacggtggaggcataagtagaagagattgttaagaagggtattcatgtgtctttgctctttctgctttatgcctcagtttggtttaaaaacttctgtactggcaaatggtggtattcagtgtgggatagtgtcataactaatttgacaatttattaatcataaaataacaataaatctctagcttttacacttga

SEQ ID NO: 196886 - DNA, 471 bp, Homo sapiens
  Payload ID: 18831
  Gene Name: ubiquilin 1
  ENST ID: ENST00000529923
  CDS Start-End: 1-471
gcggccgctgcctccgcggagcccaaaatcatgaaagtcaccgtgaagaccccgaaggaaaaggaggaattcgccgtgcccgagaatagctccgtccagcagacgttggaacttgccaggaatccagcaatgatgcaggagatgatgaggaaccaggaccgagctttgagcaacctagaaagcatcccagggggatataatgctttaaggcgcatgtacacagatattcaggaaccaatgctgagtgctgcacaagagcagtttggtggtaatccatttgcttccttggtgagcaatacatcctctggtgaaggtagtcaaccttcccgtacagaaaatagagatccactacccaatccatgggctccacagacttcccagagttcatcagcttccagcggcactgccagcactgtgggtggcactactggtagtactgccagtggcacttctgggcagagtactactgcg

SEQ ID NO: 196887 - DNA, 475 bp, Homo sapiens
  Payload ID: 18831
  Gene Name: ubiquilin 1
  ENST ID: ENST00000526134
  CDS Start-End: 1-475
tgcaacaaataactgaaaacccacaactgatgcaaaacatgttgtctgccccctacatgagaagcatgatgcagtcactaagccagaatcctgaccttgctgcacagcttcaagaacaaatgagacaacagctcccaactttcctccaacaaatgcagaatcctgatacactatcagcaatgtcaaaccctagagcaatgcaggccttgttacagattcagcagggtttacagacattagcaacggaagccccgggcctcatcccagggtttactcctggcttgggggcattaggaagcactggaggctcttcgggaactaatggatctaacgccacacctagtgaaaacacaagtcccacagcaggaaccactgaacctggacatcagcagtttattcagcagatgctgcaggctcttgctggagtaaatcctcagctacagaatccagaagtcagatttcagcaacaactgga

SEQ ID NO: 196888 - DNA, 4230 bp, Homo sapiens
  Payload ID: 18832
  Gene Name: ubiquilin 2
  Uniprot ID: Q9UHD9
  ENST ID: ENST00000338222
  CDS Start-End: 236-2110
cggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggataaatcttttctttttgccttttggccctaggatcgtgtttaggaggattatcccaccccgagattatataaatcttatcctatatttctctaacttatatggttttatttagaaaatgttttgtcctgtctggaattatcttgatgtatggatttaggtattctaacttttttgccccaaagggttagccagttgttaacatatttaccttttcccccaacatatgaaatgtcatacatgtatatactttattctgtgtttggattccctttagttccattgaacattgtggcaccagtacaccagcctgtagatgagttagaaatgggactttgtatcttttaatgtgagacctcctcttgatcttttttattttttacaatattctgacgattctgacatgtttattttaccagatgaattttacagttaatagattcttcccccaaaaatatattgagaatttggttgggattctcttaaattgatatgactgtgaggactacagaattgcattgctttccagaaacatgttgccttgtttctgaaaaactttatatatccttcaagagagttttacttaaatcctatataatttgtaataaatatgttcctaggtaatacagacatacagggaacacgttgatactgcttattggagcttttaatatgttacctatgtggtcatttttgctatataggagaagaatttatttgcatcgattattttaaattggcaatttattgaaatctattaattttagagatattcatttgatccttttgagtttttccaggtgagaaatcctatcaattatgttataattatatgttttccttttcaaaatttataacataatttctgactgcatgggttaaacattttcataacagtgctaaataataaaggtggcagtggca

SEQ ID NO: 196889 - DNA, 2407 bp, Homo sapiens
  Payload ID: 18833
  Gene Name: ubiquilin 3
  Uniprot ID: Q9H347
  ENST ID: ENST00000311659
  CDS Start-End: 149-2116
agggacctgatagtgcgggttctggcccagaaggcctcaggggtggctgtgtagcaagatgagggaggtttggagccctgcataaagagaaggacgggaccacagctgactgctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaatctttgctggcaaaatcctcaaggatcctgactcactggcacagtgtggagtgcgagatggcctcactgtccacctggtcatcaagaggcagcaccgtgccatgggcaatgagtgcccagctgcctctgtccctacccagggcccaagtcctggatcactccctcagccaagctccatttacccagcagatgggccccctgcctttagcttaggtctcctcacaggcctcagtaggctgggcttggcctatcgtggcttccctgaccagccaagctccctgatgcggcagcatgtgtctgtgcctgagtttgtgactcagctcattgatgaccccttcatcccgggtctgctgtccaacacaggcctagtacgccagctggttcttgacaacccccatatgcagcagctgatccagcacaaccctgagattgggcatattcttaacaacccggaaattatgcggcagacactggagtttttacgtaaccctgccatgatgcaggagatgatacgtagccaggaccgggtgctcagtaacttggagagcattcctggtggctacaatgtgctttgcactatgtacacagatattatggacccaatgcttaacgcagtccaggagcagtttggcggcaatccctttgccactgccactactgataatgccaccaccaccaccagccaaccttcaaggatggagaattgtgaccctctccccaacccctggacttccacacatggaggctcaggtagcaggcaaggaaggcaggatggggatcaggatgcacctgacattagaaataggtttccaaactttctgggtattataaggctctatgactatctccagcaattacacgagaacccccagtccctaggaacttatctacaggggactgcatctgccctcagccaaagccaggaaccaccaccatcagtaaacagagttcccccatcgtcaccctcatctcaggagcctgggtcaggccagcctctccccgaggagtcagtagcaatcaagggaaggtcctcctgcccagctttcctgagataccccacagagaacagtactggacaaggtggagaccaagatggtgcagggaaaagctctactggacatagcacaaacttgcctgatcttgtctcggggctgggagattctgccaacagggttccatttgctcccttatctttttcccccacggcagccattcctggaatccctgagcctccctggctgccatccccggcttatccaagatctctgaggccagatggcatgaatccagctccacagttacaggatgagatacaaccacagctgccactgctgatgcaccttcaggcagccatggcaaacccccgtgccctgcaagccctgcggcagattgagcagggtctacaggtcctagctactgaagcacctcgcctcctactctggttcatgccttgcctagcagggacgggtagtgtggcaggaggtatagagtctagagaagatccccttatgtctgaggatcctctcccaaatccacctcctgaggtgttcccagcactggactctgcagagctgggcttcctttcccctccctttctccatatgctgcaagatttagttagtacaaatccccagcagctgcagcctgaggctcactttcaggtgcagctggagcaactgcggtccatgggctttctgaatcgtgaagccaatcttcaggccctcattgctacggggggcgacgtggatgctgctgtggagaagctgagacagtcgtaggagccttattcattcaaaccatacgttttcctctgtgcctttttcccatatcctagttccctagctctcccatttttgaatacagctgcattataaaccaaatttactatgaagtcctttgctgtggaggcaatgttgttccagagtcaacgaggaagactaatggccaaaacatagtggaggtgctgtgtgtgagtcaaccacttgtaccactataccactggggggccccagtctaagctctgcttatgcctatcttgagatgcaattacacccaatttccaatgtgaa

SEQ ID NO: 196890 - DNA, 817 bp, Homo sapiens
  Payload ID: 18833
  Gene Name: ubiquilin 3
  ENST ID: ENST00000445998
  CDS Start-End: 155-817
cagaaggcctcaggggtggctgtgtagcaagatgagggaggtttggagccctgcataaagagaaggacgggaccacagctgactggatgatcttggtctccaatccccatgcccctagctgtgtccccacagatctgggcctcctgctgccaccatggccaaaggtggagaagccctgccacagggcagcccagcaccagtccaggatccccacctcatcaaggtgacagtgaagacgcccaaagacaaggaggatttctcagttacagacacatgcactatccagcagctgaaggaagagatatctcagcgctttaaggcccaccccgatcagcttgttctaatctttgctggcaaaatcctcaaggatcctgactcactggcacagtgtggagtgcgagatggcctcactgtccacctggtcatcaagaggcagcaccgtgccatgggcaatgagtgcccagctgcctctgtccctacccagggcccaagtcctggatcactccctcagccaagctccatttacccagcagatgggccccctgcctttagcttaggtctcctcacaggcctcagtaggctgggcttggcctatcgtggcttccctgaccagccaagctccctgatgcggcagcatgtgtctgtgcctgagtttgtgactcagctcattgatgaccccttcatcccgggtctgctgtccaacacaggcctagtacgccagctggttcttgacaacccccatatgcagcagctgatccagcacaaccctgagattgggcatattcttaacaacccggaaattatgcggcagacactg

SEQ ID NO: 196891 - DNA, 3576 bp, Homo sapiens
  Payload ID: 18834
  Gene Name: ubiquilin 4
  Uniprot ID: Q9NRR5
  ENST ID: ENST00000368309
  CDS Start-End: 94-1899
gttggaggcgcagaagccgagccgggccggccgggcgggcggggaggaggaggagccgggcgggctggcgggcggccgggtggcggcggcggcatggcggagccgagcggggccgagacgaggccccccattcgggtcaccgtcaagacccccaaggacaaggaggaaattgtgatctgcgatcgagcctcggtcaaggagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaaggctcaagatccagctgctgccactgcttcttccccctccacacctgaccctgcctcagcaccctccaccacgcctgcttcacccgccacccctgcccagccctccacctctggcagtgcctcttcagatgctggcagtggaagccggaggagcagtggtggggggccctctccgggggctggggagggatcccccagtgctactgcgtccatactctctggctttgggggcatcctggggctgggcagcctaggcctgggctctgccaacttcatggagctgcagcagcagatgcagcggcagctgatgtccaatcctgagatgctgtcacagatcatggagaaccccctggtccaggatatgatgtctaaccctgatctgatgcgtcacatgattatggccaacccccagatgcagcagttgatggagcggaaccctgagatcagccacatgctcaataaccctgaactcatgaggcagacaatggagcttgctcggaatccagccatgatgcaagagatgatgcggaaccaggaccgggccctgagcaaccttgagagcatccctggagggtataatgccctccgccgcatgtacacggacatccaggagcccatgttcagtgctgcccgggaacagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatatcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcctaatccctcggcccatgcctcctgcctctcccctccctcgatgtcagcattcggttcttctgtcaatccttaccctctgcagcttgtcctcccttccgtcttctccctcatcctttccaaacagcagggtgactttagaggcatgggctccaaccccttagctctgtctgagaattatggttttactgctacgtctctaacagactcttctctcctggtctccttgagcagtgctacttaaacagttttcacagtttcattgattgactctacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagagcccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtga

SEQ ID NO: 196892 - DNA, 2313 bp, Homo sapiens
  Payload ID: 18835
  Gene Name: ubiquilin-like
  Uniprot ID: Q8IYU4
  ENST ID: ENST00000380184
  CDS Start-End: 265-1692
cactttgtccaccatgggtgaattatgaatcagtagctatgccaggcctcagctgggccacatctggagaactggggtgagggcacaacatcacaaaatatctggccccagtctggtcactcatcccttttagggcaacaaggaaactatcctgtggcctgagagcacaatacctgagacaaaggccagcagaaacatttgtctgccctcaccctttctgccccagcttccacctgctccccatctgcccacccactaaagcccatgtggcatgccatctctcgaacatccaggatgtcccagagtggatgtccatcaggtctgctggcagacaaaaatatctcttcaagtgccactcgagtgatagtgaagactgcaggcaaccagaaagactttatggtagctgatgacatctcggtaaggcagttcaaggagatgctattggctcacttccaatgccagatggaccaactagtgctggtcttcatgggttgccttctcaaagaccatgacacactgagccagaggggcatcatggatggccacaccatctacttggtcatcaagtccaagcagggctccagatctctagcccattccttccgggacctgccaacgaatgatccctgccaccgggacagaaacaccaaaggaaacagcagcagagtgcaccaaccaactggtatgaatcaagctccagtggaactggcccactttgtggggtctgatgcacccaaagtgcatacccaaaacttggaagtgagccacccagagtgcaaagcacagatgctggagaatcctagcatccagcggcttctgtccaacatggagttcatgtggcagttcatttcagaacatctagacacgcaacaattgatgcagcagaacccagaagtttcccgccttcttcttgataattctgagatcctattgcagactctggagctggccaggaaccttgctatgatccaagagataatgcagatccaacaaccttcacaaaaccttgagtatccactgaacccacagccatatctgggcttagagacaatgccaggtgggaataatgccctgggtcagaactatgctgatatcaatgatcaaatgctgaacagcatgcaagatccttttggaggaaaccctttcacagctctcctggcaggacaagtgctagaacaagtccagtcttcacccccacctccaccaccatcacaggaacaacaagaccagctcacacagcatcctgcaacccgagtcatctataatagctctggtggtttctcttcaaacacctcagccaatgacacccttaacaaggtcaaccacacttccaaagccaacactgctatgatttccaccaagggccagagccatatctgtgccactcggcagccagcttggataccagccttacctagcatagagcttacccagcagcttcaagaagaatacaaggatgccactgtttctctaagtagctccagacagacattaaagggtgatctccagctgtcagatgagcagagcagctcccagatcacaggaggcatgatgcagttgcttatgaacaacccctacctggcagctcagattatgttgttcacaagtatgccccagctgagtgaacagtggaggcagcagctgcccacattcctgcagcagacacagatttctgatctgcttagtgcttaggcaaccctaaagcattccaagcaatattgcagattgagcaggccctccagctgctggccacagaggctcctgttcttctgccttgggttgcaccctacctatggggcctgggttggcttcctgcccccagctgcagctatcctgacacagtgccctgttcctggaatgtttcagatacagctgagcccaagggacctgagtgctgccacaagcctggaacagtcctgcagaggctacaatccccggatggggacccttcccaccctctgcaagctcctgagatttgttttagcaaacagatggattctctccaggccatgggatttgggaaccaccatgccaatctacaggcactcattgctactgaaggggacaccaatgctgctatccgcaagctcaagagatcccagagattctaaccaccatgcctacttgtttgcttgctacctgcctgctgacccacctgaccatctcatttgccttttgcacctttcctgatgcttccagccaggagaagtcctggaataagagttatcaaccaatgtgtcttgtactgaataatagatcattggtcgtggctgaaacatctgtcaataaaatggctacactcacttgctgcga

SEQ ID NO: 196893 - DNA, 5575 bp, Homo sapiens
  Payload ID: 18836
  Gene Name: ubiquinol-cytochrome c reductase binding protein
  Uniprot ID: P14927
  ENST ID: ENST00000287022
  CDS Start-End: 105-440
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatactgtccccatatcccagtgacttttccactttggaaatgattgttatgaagtttaagggttggatactagtcagttaaaagttttaagattatagggtaatttttaaaaatataaattagaatcattggcaaggcatggtggctcatgcctgtaatcccagcactttgggaggccgaggcgggcgggtcacctgaagtcaggaatttgagaccagcctggccaacatggtgaaaccctgtctctactaaaaatacaaaaaattagctaggcgtgatggtaggcacctgtaatcccagctactcgggaggctgagggaggagaattgcttgaccccaggaggtggaggttgcagtgagcctagatcacaccactgcacttcagcctgagcgacattgactgtctcaaaaaaaaaattaggattattcaatgttgtcatcatttccactcctaaattctgaaatgctttctttggtagaggtgagagtgtggagccacagctagtagagaaggaacagtaggacctgcagcctccctggttttccaggacaagtcattgctgtgtgtggcaggaatgccttacctcaaataacaaaacagtgtgaaaaacgaatttgtgttacatttaaagtttgtaaagcaatgagaaatgtgtgtatcataaagagcatctttaaatttttgctaaaatattagcctcttaaattctctaggaaccccctcccccgcttttttttttcctttcgctggtcgttatttttctaaacctatcctgaaatcatgtcaattttcttttgtatggttgaagacaactagatcacttgataatggttttgctcaggtcacattgtgacaaggttttaatgtagtcctactttgcagaaggaggccaagaagatgggctgtctagaaccccctttaaaagcatttgtctattcagaaaattttcctgagtagatctctgcaaaggctcttttaatagtgatttcaagatcacgtttgcaggactctggtctattcgttcagacgtctactgtgcacaattacaaggagactacaactgaggcatctcaaagagcactgtcaaggtgtgtagggagccgggtgggtggagggaggctgggctctgaccctagaaaccatgcttatgaatgctgttaatgtttaaagcaagcctaagggcactgctgaaggacaggggaacaaatagaactgaccaagactgaggtataacaggaacccccaggctatccacctgctcaaggtaaagtgtggtattacataaggcaacctctgattttgtaagagttcttcctaaagccaaagtgtatgcctattctatgtttccagattacttcattcttctaaatgagaacaagtgtgcaaaagttctttgaacactagatcaatgttttgtgttcattataaattatggttatcgtcctgcttgttatgaagactaagaaagtagatctagtatttggctcacacaggtgaatgggtgagaatttgttaatccatcagtgaagtcctttcatttgaaagagagggcctttctattatcaaaagccgtcctgtgtggaaaatcaccatgagagtgcctgaaacacaggcactctgcattgtcctgtagaccaaatctacattgtcctgtagtctggtctacattgtcctgtagaccgaatggtagagtgattcagagctaattctgggttagactgcacaggtctgaatctatttgctcactgtgtagtgctttaggaatacaatttaacctctccgtgcttcagtttgtttgtccctaagatagagctaatgatagaaacctacttcacccagttgtgaaaattaactgactgcatgtcaagcactaacagtttctggcatatagtatgcataatgtaaattatgtgctgagaagcgagaaagaataacttgggaaaacgctgaatatcatcaatgtcgaatagctaaccagtagctaaggtccaaggtctcctctcttccttctatgtggcactcttgtttctggttcatctactccccttgggtgtcacctccttgagtgaagtacctgctggagatgagaagagtggaactggatctgcatgacagctttgattaggatggagctaagacttggctatctccctgttttgtgttttggatgggtgacattttaaaactgccaatattcaaatcctgctaatttgctttgtacagtttaaaatgtttgatatcttttgttgtttaaagtttgagattggttttgaatatacagttttcctacatcttgaagaaagttatgtttgtttactctgaagtggtctatgttctgtttgtttgttttactatactttgcaaaaaaacagatggctggcttatgttcactgttgtagtgcactacctagtatcacttggccttcctgttgtcaagatgtaggaagcagcgtaagggatgtcgggccttcagacccccaattgccagctgtggtcctagttccagattgcatggaaatatttgataacattcctgcactgagttatcatggtctgaatatttatgtgacgctctacgagtggtaccaaaatgttagtgatggagtttttactaatggcaccttttcctgtttttaaattctagaatcttaataaatccaaagtgtacattttggtagtgatttcatttagttatttactttaaggactcccttttcaagcattaactctgcactaattttgacttatgaaaagattcagcagtaagaataaaaactgggccaaagcccaaagtaataatccttcacaaataggatggagttttaaaaatatgggcatcctgtgtgtagctttgaaaataaccaaactacttggaattaaaaagttaggtgaacatgaagattgtcataaccaaatccttgacagcttgatggatgaagagcagatgggtttatggtgtatgggaggaagcatggattttaggagggacagtatcagagagggatggttagaaagtgagtaagacaggttgctctttggaaaacaaggaaaatccctttattagaacaaggcatgaaattctgccactaggtggcgatgccctataactttacaacttagtgtacatcacacgagcactatggaagatttctccattctgcgccccaccaactccctcccctccttcatttttcaggatgacaacaccttagaggtttatggccatcaggagaatttactactaagctatatactgatgtaatgaaatctaatatatgttgtgcaatgaattatgagatgttatttagtttcaggattttattacttcaatcagttatgaccatatttccttttatatgattgctcactctttaaacataccagatgactgtataaggaacacctaataaagtctatagatgttaaaatattttaaatgttttaatttatatgccataatttgtttacattctggttatactggcgttcatattaaaagccataacatgttagaatctgagatctcaggtcggatagtgcctctaagttatattttgctaagaaattttattgtattagcaattgagcaagaaagaagaactgaatcattatacggtggttaatttttagcatagatgtcagaaagcctgttaatattccagaggcttatgataaactatttaaattgtcattctggattctgattatatctcctacaaagaaagagtgtattatttattgaactttttgtttgaatacatgtgcctatttttgcataaatgtaaaaatgtaattttaaaataaacccctgaaaacttctggtaacattatccagttgaataattgttctgttagtattctaaatattttaagaaaattgtatacatatctgtgacaattgtattcacaagccaaaccaaaaaaagataattatttgttttacaaaggagtcagcttacaatttttctcttatgcatgcatttaaaatgtggtttgccattaaactggaaacactgatctgaggccaatgatttaggcaagtcattagtctaaagattggcttcctcagctagaaaatgaagggctttgactaaaaagtctttttcatttcagtaccaaaacattctgggtctgtgatttaacttacgctctttattgttgggatgaactaatactgatggaatactagctttgtactaggcactgttcgtatgttgtctcttttaatcctccctgcaaccttctggcatggctattataatgcccattgtatggaagaagaaattaggcttcgaaagtccattttatgcttgttcattacataattttctggattttttaaattgatgtatgtgtttatgttccaggctaggcagaagctaggaagaatatagcagcctcgtcactgttgaaatctggggctagataattctttgttgtgggggcctcctctgtgtgttacaggatatttagcagcatcctggcttctacacgataggtaccagtagcgcctcctgcctccaactgtaacaaccaaaaatgttttgagacattgtctggaaatgttcccctgggggagcagaatt

SEQ ID NO: 196894 - DNA, 982 bp, Homo sapiens
  Payload ID: 18836
  Gene Name: ubiquinol-cytochrome c reductase binding protein
  ENST ID: ENST00000521036
  CDS Start-End: 17-502
tctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgtggacattcatttctttttcttcccgaaaagacttccccctcataacctatcaaagcaacttatcacaccatcaccacagatttgacattttaaaaagcagatagttcttaggttgagaatatgttttctaaaattggaaattcaaaagaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaaga

SEQ ID NO: 196895 - DNA, 515 bp, Homo sapiens
  Payload ID: 18836
  Gene Name: ubiquinol-cytochrome c reductase binding protein
  ENST ID: ENST00000517523
  CDS Start-End: 70-300
tcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagagaagaaaaccacattgagtcttacgtgtgaaatgattcttctgaaattactaagcaagtctctaatatagagagccaggactaaaatccaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaa

SEQ ID NO: 196896 - DNA, 595 bp, Homo sapiens
  Payload ID: 18836
  Gene Name: ubiquinol-cytochrome c reductase binding protein
  Uniprot ID: P14927
  ENST ID: ENST00000518406
  CDS Start-End: 10-432
ctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattg

SEQ ID NO: 196897 - DNA, 695 bp, Homo sapiens
  Payload ID: 18836
  Gene Name: ubiquinol-cytochrome c reductase binding protein
  ENST ID: ENST00000523920
  CDS Start-End: 17-502
tctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgtggacattcatttctttttcttcccgaaaagacttccccctcataacctatcaaagcaacttatcacaccatcaccacagatttgacattttaaaaagcagatagttcttaggttgagaatatgttttctaaaattggaaattcaaaagtaattgcttttttcttgttattgaagacctgttgagtgtttgggatatatcagtacgtgatggtaacatataatatttcattcattctttaggaaaatttctaccttgaaccgtatctgaaagaggttat

SEQ ID NO: 196898 - DNA, 1041 bp, Homo sapiens
  Payload ID: 18836
  Gene Name: ubiquinol-cytochrome c reductase binding protein
  ENST ID: ENST00000517603
  CDS Start-End: 14-94
ctttctggtcaaaatggctggtaagcaggccgatattgaaggagtcttactaaattcaagacactgcttctgtgcgtgtttgggaactacatagaccagatctcaactcccattagctaactctgaccttgggtgggatcacttcttttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatactgtccccatatcccagtgacttttcc

SEQ ID NO: 196899 - DNA, 2188 bp, Homo sapiens
  Payload ID: 18837
  Gene Name: ubiquinol-cytochrome c reductase complex assembly factor 1
  Uniprot ID: Q9NVA1
  ENST ID: ENST00000349714
  CDS Start-End: 1-819
atggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 196900 - DNA, 2036 bp, Homo sapiens
  Payload ID: 18837
  Gene Name: ubiquinol-cytochrome c reductase complex assembly factor 1
  ENST ID: ENST00000359226
  CDS Start-End: 8-667
gaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatgggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 196901 - DNA, 2133 bp, Homo sapiens
  Payload ID: 18837
  Gene Name: ubiquinol-cytochrome c reductase complex assembly factor 1
  Uniprot ID: Q9NVA1
  ENST ID: ENST00000374380
  CDS Start-End: 69-764
caaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 196902 - DNA, 2201 bp, Homo sapiens
  Payload ID: 18837
  Gene Name: ubiquinol-cytochrome c reductase complex assembly factor 1
  Uniprot ID: Q9NVA1
  ENST ID: ENST00000374384
  CDS Start-End: 11-832
attgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 196903 - DNA, 2447 bp, Homo sapiens
  Payload ID: 18837
  Gene Name: ubiquinol-cytochrome c reductase complex assembly factor 1
  Uniprot ID: Q9NVA1
  ENST ID: ENST00000374385
  CDS Start-End: 179-1078
cagggagagcgtgcccgggcacgacagcctggtgcacagccgagaaaacaacagcgcgtgcgcgtagcgacctctttgcgcctgcgccccccttgccagtctttcgccggcaaaaggaggacgtagaaaaggggacaccggaaactcactcttcacccggaaatggttattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 196904 - DNA, 2329 bp, Homo sapiens
  Payload ID: 18837
  Gene Name: ubiquinol-cytochrome c reductase complex assembly factor 1
  ENST ID: ENST00000374394
  CDS Start-End: 11-79
attgaggaacatggcgttgctggtgcgagtccttacggagttttgctcttgttgcgcaagctggagtgcaatggcgtgatcttggctcactgcaacctctgcctcccgggttcaagcgattctcctgcctcagcctcctgagtagctgggattacagaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 196905 - DNA, 566 bp, Homo sapiens
  Payload ID: 18837
  Gene Name: ubiquinol-cytochrome c reductase complex assembly factor 1
  ENST ID: ENST00000397553
  CDS Start-End: 11-160
attgaggaacatggcgttgctggtgcgagtccttaggaaccagactagcatttctcagtgggttccagtatgcagccgattgatacctgtgtctcctacccaaggacagggggacagggctctgtctcgcacttcccagacagggtcttgctcttgctgagtcgcccaggttgaagtgcagtggtgtgatgatagctccctgcagcctcgatcttctgggctcaatggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtg

SEQ ID NO: 196906 - DNA, 3638 bp, Homo sapiens
  Payload ID: 18837
  Gene Name: ubiquinol-cytochrome c reductase complex assembly factor 1
  ENST ID: ENST00000397554
  CDS Start-End: 12-677
tattgaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggtaagtgagtgctgtcagatgcttgtcctggacaattccagagaagggtttgagtttggagttttatctgttgtaaaatggccctgcttttagatttctgtgaaatgctgcctaatatcaagtggcagttccgctaaagtcactttttctgcctctgtggaaactaatactccacagatactttatgtgtttgtacacattatagtgatttgtcagtgtgaagtcatcctgtatggagatgggattgtaaagcccaaatcgtggtgataggagggatggatttggtgaatggagggaatcaaatgataatccagttaaggatactatacctttgacaccagttcaatatttgaaccagtccttctataaattagttctgatgggaggccctggtatggggcctgcactgtcttcaggaactgaaactcaagctccttgatcactggcaacctagaagagtctggtaagatacctcctgaaaatgtacattagtacatttaataattaacctgagaaaggggaatatattatatatatatatatgtcacatgggatgtaatgacaatagaaaaatgaaaccaaaacactagaatatagctggttatacagatcatagtgtgtccggagttggttccttgtggtgggttcttggtctcgcgacttcaagaatgaagccgcagaccttcgctgtgagtgttacagctcttaaagatggtgtgtccggagtttcttccttccagtgggttcgtggtctcgctgacttcaagaatgaagccgcagaccttcacagcaagtgttaccagctcttaaaggtggtgcggacccaaagagtgagcagcagcaagatttatggtgaagaccgaaagaacaaagcttccacagtgtggaagggggacctgagcgggttgccactgctggctagggtggccagcttttattcccttatttgtccctgcccatgtctgctgattggtccattttacagagtgctgattggtgcgtttttacagagtgctgattggtgcatttacaatcctgtagctagacacagagcgctgattggtgcgtttttacagaatgctgattggtgcatttacaatcctctagctagacacagagcactgattggtgcaagtatccacccgacccagaagcccagctggcttcacctcccactagtatcttcttttgtttatgttgtgtattttgtgtatctagatcacgttttagtagcttgtagttccctgttactgggaagcatttcattgcctcccagcttgggagcatccaaagtagaaccatgactgggtcatgaaatgggttaatttggtttctttcattacagggcaaagttctccctgtggactgagaaataaacatattataaaagttacatatgctcatagaatagaaatcaaagagtaaaaagtattgagtgtaaaaaacaagtgtcttttttccccccagtctaactccccagaagtaaccttttttattttttatgttattttttcttaccttcaaggaaggagaaaagtaaccatttttgagttgatgcgtatccttcgcctgagagctatctttgtaatcatcctttttggttcctttttcattttttgctttctttctgtcgtagctgctgtgtaatatagagaaaaaaagtattttttcagctctctcactcaattacaattacacagaaggtttctgtgacacatttgtgggagtttctccccacacagcaaacaggcagtcaattctggagagaggtcaccaggtgggtgtcctctaacccaattcaattccaacattgtgtactcggagatagtgtcagatcccacaggttgagggctctgcccacaagactgcccccaacttgccacaccaattgcaagctccaggctgttttacctgtgcttctggccaaccgattataaattggggttccccacccctttctttggttcaattaatttgctggagcggctcacagaactcagggaaacacttattacattaccggtttattataaaggatattgcaagggatacagatgaagagatgcataggacaagatgggggaaggggtgaggagattccatacctttcctggtgtgcagctgtccagaaacctccacctgttcagctatctggaagtgccccaaacccagtccttttaagggttttatggaagctgcattatgtaggcacaactgattaaaccactggccattggaaatcagtcagcctctctgccctccttggaggttgggagatgggacagaaagtcctaaccttctaatcctcccttggtttttcagtgaccagcccctaccctgaagctacctaagtgcgccagccaccaatcattagcatacaaaatgacaccactttggaaaggccaaagattttaggagttgtatgccaggaagggagttgaagaccaactatatatttcacaatatcacagctgcccagagtgagatcggcagcctttaaggtattcatccagctgaatgttcccacatgccctcaagtacttaccacccaactctgtagcagtgcacagtggacataaggtggtgttggcagtctcagtcctatttaatgatggccagagatacctcctggtcagccaaagccctggctgactgccaggcagttgcgcagtagctcttcctgtagtgaaactgttcttcttatcattgttgactaaactctgttggaagttgtctcactagccatatgagccacagctgtctctatcctgaatagcttaatgagccataggttgctgactcctggactgcaggaaccttttagttgcctctcgccacagttgaatttccttctggacctccatctctcttcatcacagttgtcaacacttgagccttctcccatgttacttcttatgcagtgtcccttctacttaactgtaagttttataaaagcagaaaaccgtcttattcagttttttgcttatgcagtaaacattgaataattgtcaaatgaataaataattgtcaaataaatgaatatattgaatacca

SEQ ID NO: 196907 - DNA, 1284 bp, Homo sapiens
  Payload ID: 18837
  Gene Name: ubiquinol-cytochrome c reductase complex assembly factor 1
  ENST ID: ENST00000397556
  CDS Start-End: 122-802
tctttagaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgc

SEQ ID NO: 196908 - DNA, 1035 bp, Homo sapiens
  Payload ID: 18837
  Gene Name: ubiquinol-cytochrome c reductase complex assembly factor 1
  ENST ID: ENST00000453855
  CDS Start-End: 1-381
gcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattcca

SEQ ID NO: 196909 - DNA, 736 bp, Homo sapiens
  Payload ID: 18837
  Gene Name: ubiquinol-cytochrome c reductase complex assembly factor 1
  ENST ID: ENST00000438533
  CDS Start-End: 7-736
aggaacatggcgttgctggtgcgagtccttaggaaccagactagcatttctcagtgggttccagtatgcagccgattgatacctgtgtctcctacccaaggacagggggacagggctctgtctcgcacttcccaggtcccctggttggaaacttctgcttcagaatggcatcctcagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccc

SEQ ID NO: 196910 - DNA, 758 bp, Homo sapiens
  Payload ID: 18837
  Gene Name: ubiquinol-cytochrome c reductase complex assembly factor 1
  ENST ID: ENST00000424405
  CDS Start-End: 11-758
attgaggaacatggcgttgctggtgcgagtccttaggaaccagactagcatttctcagtgggttccagtatgcagccgattgatacctgtgtctcctacccaaggacagggggacagggctctgtctcgcacttcccagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaaga

SEQ ID NO: 196911 - DNA, 1987 bp, Homo sapiens
  Payload ID: 18837
  Gene Name: ubiquinol-cytochrome c reductase complex assembly factor 1
  ENST ID: ENST00000457259
  CDS Start-End: 1-166
gttgctggtgcgagtccttaggaaccagactagcatttctcagtgggttccagtatgcagccgattgatacctgtgtctcctacccaaggacagggggacagggctctgtctcgcacttcccagggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgaggaaacagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaagggctttcacatcctaagtcatttggaaggaggccttgagaacaaagtcacctttgtcactcccagtgaactgaatgaggaacatgctgtctcctgtcttggcctcccctttcatgagatactggggagaagagaacattcctcctggcttagttgtagcagacccagacctgtgcccagctttggtcccccttcccaacttctgaagcacgtgctgcagagccaccttggtctgagcacctgaggaccagcccctcctccctcagtgcgggtcatctcttgggggattttcttaaagtgaagaaagggggtggggaaccatattgcccctccctcccccatcaaacttccttcatttaacttgctataaaatgagtcatataaagaaactctatatgggtgaggtatatcccacttctgtgaaaacattacaaatcaaaccgcttctctcagtttatttaagatgcttttgttgcgagcggagctctagagtgaagcctcctgtgtgtgtgtgagataataacaccttgtaactcattacagctgggcactatttacataaaccagagctgagccaggcaggaatttgctgattaatttatttttaatggagtgaagtataccatgcaccaaaataaactttactgtgtgtacctaactgctcctggaa

SEQ ID NO: 196912 - DNA, 692 bp, Homo sapiens
  Payload ID: 18837
  Gene Name: ubiquinol-cytochrome c reductase complex assembly factor 1
  ENST ID: ENST00000443429
  CDS Start-End: 8-382
gaggaacatggcgttgctggtgcgagtccttaggaaccagactagcatttctcagtgggttccagtatgcagccgattgatacctgtgtctcctacccaaggacagggggacagggctctgtctcgcacttcccagtggccccagatgagccagtcccgagcatgtggtggatcagaacagattcctggaatagacatacagctgaataggaagtatcacaccacacgtaagctttctactaccaaagattccccacagcctgttgaggagaaggttggtgctttcacaaagataatagaagccatgggattcacgggacctttgaaatacagtaaatggggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggttaatccctatatcctgaagaagaacatgatcctcatgacaaatcatttctatgcagcgatcttgggatatgatgaggggatcctttcagatgatcatgggctggccgctgccctctggagaaccttcttcaaccggaaatgtgaagaccctcgacatcttgaattgctggtagagtatgtgag

SEQ ID NO: 196913 - DNA, 1017 bp, Homo sapiens
  Payload ID: 18837
  Gene Name: ubiquinol-cytochrome c reductase complex assembly factor 1
  ENST ID: ENST00000491040
  CDS Start-End: 11-145
attgaggaacatggcgttgctggtgcgagtccttaggaaccagactagcatttctcagtgggttccagtatgcagccgattgatacctgtgtctcctacccaaggacagggggacagggctctgtctcgcacttcccagggttaaagaaaaaaaatcattttcattccatgtgttccatttcttcttggaataaaccagaattgaagagtcagccctcttcctgctccctctcacccttttttattgtaaagctttctactaccaaagattccccacagcctgttgaggagaaggttggtgctttcacaaagataatagaagccatgggattcacgggacctttgaaatacagtaaatggaagattaagattgcggccctgcgcatgtatactagctgtgtggagaaaactgacttcgaggaattctttctaaggtgtcagatgcctgatacattcaattcatggtttcttataaccctactccacgtctggatgtgtctagtccgaatgaagcaggaaggccggagtgggaagtacatgtgtcgtatcatagttcattttatgtgggaggatgttcagcagcgcggcagagtcatgggggtaagtgagtgctgtcagatgcttgtcctggacaattccagagaagggtttgagtttggagttttatctgttgtaaaatggccctgcttttagatttctgtgaaatgctgcctaatatcaagtggcagttccgctaaagtcactttttctgcctctgtggaaactaatactccacagatactttatgtgtttgtacacattatagtgatttgtcagtgtgaagtcatcctgtatggagatgggattgtaaagcccaaatcgtggtgataggagggatggatttggtgaatggagggaatcaaatgataatccagttaaggatactatacctttgacaccagttcaatatttgaaccagtccttctataaattagttctgatgggaggccctggtatggggcctgcactgtcttcagg

SEQ ID NO: 196914 - DNA, 432 bp, Homo sapiens
  Payload ID: 18838
  Gene Name: ubiquinol-cytochrome c reductase complex assembly factor 2
  ENST ID: ENST00000374214
  CDS Start-End: 42-347
gccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttga

SEQ ID NO: 196915 - DNA, 509 bp, Homo sapiens
  Payload ID: 18838
  Gene Name: ubiquinol-cytochrome c reductase complex assembly factor 2
  ENST ID: ENST00000374231
  CDS Start-End: 1-379
ggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggcactgccagatgcagaagaggatgtctaggcaagagggccttaaactcccccatctccagtgatggggatcccctcaaaggacctacctggcagctgtc

SEQ ID NO: 196916 - DNA, 1314 bp, Homo sapiens
  Payload ID: 18838
  Gene Name: ubiquinol-cytochrome c reductase complex assembly factor 2
  Uniprot ID: Q9BRT2
  ENST ID: ENST00000607484
  CDS Start-End: 42-422
gccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgcacatacctaggtgtggagtcttgtacattgccatcgtcaataaaactgccccagtttccccttgaccttacggtttgggaatctcctctagctttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaaaagggcatcctgttgcaaacagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcattattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaacca

SEQ ID NO: 196917 - DNA, 1947 bp, Homo sapiens
  Payload ID: 18839
  Gene Name: ubiquinol-cytochrome c reductase complex assembly factor 3
  Uniprot ID: Q6UW78
  ENST ID: ENST00000377953
  CDS Start-End: 93-374
ctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccggcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacccagaatgagccctgcagtcgacacctaccaatgcttagagacgcgtggtcggtgctgggggcgcggcctggagctgctgcctgtcccaccccaccagaagaggctgatcccgataggtatctgaccacattttttttttttttttttttttgagacggagtcaatgtcacccaggctggagtgcagtggcacgatctcggctcactgcaacctccgcccctgggttccagcaattctcctgcctcagcttcccgagtagccgggatcacaagtgcgcgccaccaagcccagctaacttttgtgtttttagttgagacagggttcaccatgttggctagactggtctcgaactccagacccaggtgatccgcccgcctcggcctcccaaagggctgggattacaggcgtgaaccacctcgccctgccgcggccacattttttcttttttttgagatggagtcttgctcttgtcacccaggcaggagtgcagtggcgcaatcttggctcactgcaacctctgcctcctgggttcaagctgttctccttactcagcctcccatgtagctgggattacaggcgtccgcaaccacgcccggctgatattagtagttttagtagaggcgggtttcaccatgtggccaggctgatctcgaactcctgacctcaggcagttcacccgtctcagcctcccaaagtgctgggattagaggcgtgagccactgcgcccggccaaccacattttcaaaacaggtcatgtggtgtcaggttggagtgtacttccagggataaccgtgggacattcttgaaatctgaactatcctgggaagtcttgaagtaatggatgcctatagtggacactcaggactcctgtccttggagcgagattggaggggcatctagcacttaacatatgccacaatgctttctgtggccattatttaacctctggttaaacaagcttaggaggctgacttactagtagtaaaaggagtgtgctttgagtcacagatcctggttgaactccagcatgttacaaacctcagccctgttctatgaaaggtcataactacgaggattattgtaaaacattaatttagaaatgtaaagtggtccccaatctctggatctggtcaggatttattggagctgccactgaggggattaaataagtggggtcaaagccccacagcctagtcaaccaagttgctcctcttttgtctatcctgtggttcccaagcaagactgcaattgaaaaaaaggctgctgttattaaagtcagaacaccaaataaagctttttttttttttttgag

SEQ ID NO: 196918 - DNA, 2288 bp, Homo sapiens
  Payload ID: 18839
  Gene Name: ubiquinol-cytochrome c reductase complex assembly factor 3
  Uniprot ID: Q6UW78
  ENST ID: ENST00000531323
  CDS Start-End: 544-825
attaaagccctgtgggccaagagttgtgataaccaacttggaatttcctgactcctatgcttactgatttttcccaacctgagttgaggggatggagagggatgtgtatgtgtgtagatgccctccatgcgctgtgttgaaaacgcgcgggtgactgcaggaaaccacagagcacagctcgggcctctactgatcgggaaacgtcggaagacagaaaaatgggcaatcataaaacccacggcaaccatgaagacacgcactctccccctagcaatcccaccccggaattgaggacacagggtccccgcgctcagcccttggtgccagcacttcttggacacctcaaccccctcagctaaacctgagatccaagcgctccggattccaaacgtttcctcgagcaggtcctctctagccggccgcttatctatggtttctgctatagggcgctctagcctgcgccaaggggtagtgagaccgcgcggcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccggcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccacccagaatgagccctgcagtcgacacctaccaatgcttagagacgcgtggtcggtgctgggggcgcggcctggagctgctgcctgtcccaccccaccagaagaggctgatcccgataggtatctgaccacattttttttttttttttttttttgagacggagtcaatgtcacccaggctggagtgcagtggcacgatctcggctcactgcaacctccgcccctgggttccagcaattctcctgcctcagcttcccgagtagccgggatcacaagtgcgcgccaccaagcccagctaacttttgtgtttttagttgagacagggttcaccatgttggctagactggtctcgaactccagacccaggtgatccgcccgcctcggcctcccaaagggctgggattacaggcgtgaaccacctcgccctgccgcggccacattttttcttttttttgagatggagtcttgctcttgtcacccaggcaggagtgcagtggcgcaatcttggctcactgcaacctctgcctcctgggttcaagctgttctccttactcagcctcccatgtagctgggattacaggcgtccgcaaccacgcccggctgatattagtagttttagtagaggcgggtttcaccatgtggccaggctgatctcgaactcctgacctcaggcagttcacccgtctcagcctcccaaagtgctgggattagaggcgtgagccactgcgcccggccaaccacattttcaaaacaggtcatgtggtgtcaggttggagtgtacttccagggataaccgtgggacattcttgaaatctgaactatcctgggaagtcttgaagtaatggatgcctatagtggacactcaggactcctgtccttggagcgagattggaggggcatctagcacttaacatatgccacaatgctttctgtggccattatttaacctctggttaaacaagcttaggaggctgacttactagtagtaaaaggagtgtgctttgagtcacagatcctggttgaactccagcatgttacaaacctcagccctgttctatgaaaggtcataactacgaggattattgtaaaacattaatttagaaatgtaaagtggtccccaatctctggatctggtcaggatttattggagctgccactgaggggattaaataagtggggtcaaagccccacagcctagtcaaccaa

SEQ ID NO: 196919 - DNA, 1985 bp, Homo sapiens
  Payload ID: 18840
  Gene Name: ubiquinol-cytochrome c reductase core protein I
  Uniprot ID: P31930
  ENST ID: ENST00000203407
  CDS Start-End: 418-1860
tactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggaggcggccgagcaccaactgtacggtactgcgcctgcgccgcgaccgccaacgcgcccagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgaga

SEQ ID NO: 196920 - DNA, 778 bp, Homo sapiens
  Payload ID: 18840
  Gene Name: ubiquinol-cytochrome c reductase core protein I
  ENST ID: ENST00000412343
  CDS Start-End: 17-223
cgactgcagctggaagatggcggcgtccgtggtctgtcgggccgctaccgccggggcacaagtgctattgcgcgcccgccgctcggtgaggtggtggcgagagcgcggggcttcgggacagggcttcgggaagcggacagccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggagg

SEQ ID NO: 196921 - DNA, 1387 bp, Homo sapiens
  Payload ID: 18840
  Gene Name: ubiquinol-cytochrome c reductase core protein I
  ENST ID: ENST00000415995
  CDS Start-End: 7-372
tggaagatggcggcgtccgtggtctgtcgggccgctaccgccggggcacaagtgctattgcgcgcccgccgctcggtgaggtgggagtgtggattgatgttggcagccgttttgagactgagaagaataatggggcaggctactttttggagcatctggctttcaagggaacaaagaatcggcctggcagtgccctggagaaggaggtggagagcatgggggcccatcttaatgcctacagcacccgggagcacacagcttactacatcaaggcgctgtccaaggatctgccgaaagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggaagctgtctcgtgcagacttgaccgagtacctcagcacacattacaaggcccctcgaatggtgctggcagcagctggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtgcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtcccccccccaccacaaacacagcacttcg

SEQ ID NO: 196922 - DNA, 2615 bp, Homo sapiens
  Payload ID: 18841
  Gene Name: ubiquinol-cytochrome c reductase core protein II
  Uniprot ID: P22695
  ENST ID: ENST00000268379
  CDS Start-End: 765-2126
actatccaaaacatttctattttcctaacacaaaaactatagctaagtttttatattctatgtagccccagcctaggacgtaaattccacgagaccaaaagccttgtgatgattccccgaggttgctgaccctcccggtgtgtcccgggcctgctctgggggacacagcggcgaatacgttgaacgaggcccctgtttcacggagctaaagatccagtaaggacttcacccagcgagaggcaactacgccgggcttcgatacccaatacctctgcagaaaggtggagtggcaggaatctcctgaagcctccaacgtccaggaacgcggaaacccagggcctccagtgcaggtgtcatcccggagggcgcatgcggagtcccaagagaggcgcgtcccattggacaatgctgagcggaagagcccaagatagcggggggagttgtgacaggctgctgcagacgtacttagaaaaggggtgcatactggatattcaggctaggagaagaacgcaaaaagcagtgacgtacattattctctgcatatatttacttgggaaattgtgcgtctccctattctgagtcttggaggaattggactggtccaaccttataaagagagcagtagagcgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacatacatttcctatcaatcata

SEQ ID NO: 196923 - DNA, 565 bp, Homo sapiens
  Payload ID: 18841
  Gene Name: ubiquinol-cytochrome c reductase core protein II
  ENST ID: ENST00000565331
  CDS Start-End: 38-565
atccggcagtgaccgtgtgtcagaacaatcttgaatcatgaagctactaaccagagccggctctttctcgtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggag

SEQ ID NO: 196924 - DNA, 1415 bp, Homo sapiens
  Payload ID: 18841
  Gene Name: ubiquinol-cytochrome c reductase core protein II
  ENST ID: ENST00000561553
  CDS Start-End: 54-1292
atcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaa

SEQ ID NO: 196925 - DNA, 1406 bp, Homo sapiens
  Payload ID: 18841
  Gene Name: ubiquinol-cytochrome c reductase core protein II
  ENST ID: ENST00000563898
  CDS Start-End: 38-1048
atccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaac

SEQ ID NO: 196926 - DNA, 542 bp, Homo sapiens
  Payload ID: 18841
  Gene Name: ubiquinol-cytochrome c reductase core protein II
  ENST ID: ENST00000564095
  CDS Start-End: 22-372
gtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagggaaatgggtaaagtatgacagagtcatgatgagaccactatacagccattacggaatgaactagatccatacgtcaacatagcacaactgaagggcaaaatagagtgtgaacaagcaagtttcaagatttctttaagtgtgaccgcaacaagggaaaacatggcttatactgtggaatgcctgcgggg

SEQ ID NO: 196927 - DNA, 929 bp, Homo sapiens
  Payload ID: 18841
  Gene Name: ubiquinol-cytochrome c reductase core protein II
  ENST ID: ENST00000565464
  CDS Start-End: 127-525
agagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgttcacagcatcttcaaccaggagcagattctatctcaagaaaccactttgtttgctcatccataagaagcatctcctcatctgttcaagctttatcataagattgcagccattcagtcacatcttcaggccccacttctagttctcttgctactcccaccatagttgcagtttcttccccctctgaagtcttgcctctcagagtcatccataaggggaaatgggtaaagtatgacagagtcatgatgagaccactatacagccattacggaatgaactagatccatacgtcaacatagcacaactgaagggcaaaatagagtgtgaacaagcaagtttcaagatttctttaagtgtgaccgcaacaagggaaaacatggcttatactgtggaatgcctgcggggtgatgttgatattctaatggagttcctgctcaatgtcaccacagcaccagaatttcgtcgttggg

SEQ ID NO: 196928 - DNA, 586 bp, Homo sapiens
  Payload ID: 18841
  Gene Name: ubiquinol-cytochrome c reductase core protein II
  ENST ID: ENST00000618892
  CDS Start-End: 1-211
gttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgttcacagcatcttcaaccaggagcagattctatctcaagaaaccactttgtttgctcatccataagaagcatctcctcatctgttcaagctttatcataagattgcagccattcagtcacatcttcaggccccacttctagttctcttgctactcccaccatagttgcagtttcttccccctctgaagtcttgcctctcagagtcatccataagggttggaattggcttcttccaaactcacgttaatgttgatactttgacatcctcccatgagtcacaaatgttcttaatggtgtctagaatggtgaattctttccagaaagttttttaatttactttgcccagatccatcagcgtcttcactatctgtggtagctgtagccttacaaaatgtatttcttaaataataagacttgaaaataaaaattactccttgatc

SEQ ID NO: 196929 - DNA, 535 bp, Homo sapiens
  Payload ID: 18841
  Gene Name: ubiquinol-cytochrome c reductase core protein II
  ENST ID: ENST00000630839
  CDS Start-End: 137-535
gcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgttcacagcatcttcaaccaggagcagattctatctcaagaaaccactttgtttgctcatccataa

SEQ ID NO: 196930 - DNA, 604 bp, Homo sapiens
  Payload ID: 18842
  Gene Name: ubiquinol-cytochrome c reductase hinge protein
  Uniprot ID: P07919
  ENST ID: ENST00000311672
  CDS Start-End: 137-412
gaccacgatgagtgtgccgcacttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaa

SEQ ID NO: 196931 - DNA, 674 bp, Homo sapiens
  Payload ID: 18842
  Gene Name: ubiquinol-cytochrome c reductase hinge protein
  ENST ID: ENST00000496387
  CDS Start-End: 59-367
tgaactgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaa

SEQ ID NO: 196932 - DNA, 553 bp, Homo sapiens
  Payload ID: 18842
  Gene Name: ubiquinol-cytochrome c reductase hinge protein
  ENST ID: ENST00000489056
  CDS Start-End: 70-246
cttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggtaagaactgtctcaggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaa

SEQ ID NO: 196933 - DNA, 2180 bp, Homo sapiens
  Payload ID: 18843
  Gene Name: ubiquinol-cytochrome c reductase hinge protein like
  ENST ID: ENST00000483273
  CDS Start-End: 1700-1975
gtgagactctgtctcaaaaacaaaacaaaacaaaaacagaaagaatcagagtcaacaaatcagtatggatgcagattcctcagatgccaggaatcccaggataaatggcaggggtgaaccaaatacttcccattcttccctcaccaccctcctccatccaataaagaagtaaataaattcctcaagtcccctctgccccagtgcatggaatgtttacctgtggactaggactggtctacatgccaaacaggccttgcctcctgggcggcatgtttgcaggggatccttgctgatgatgttggcctcctcctgcaccctcccactccatggctgtctcacctgagagagctttcttccttttgcattaagtgtgagtcctgataaattcaaaaaagcctccaggtgacatcattttaacaccagttaacaatcacaaatctgggtgaatgagcctcagagtttttcttgacagtagtgtgcgtgcgtgtgtgtgtgcgtgttttccatggaaaaataaaatgtattacacaaactatcagtattaattacagaaaggtggccaggtgcagtgcctcacgcctgtaatcctggcactttgggaggccaaggcgggcagattgcctgagctcaggagtttgagaccagcctggtcaaacatggtgaaaccctgtatctactaaaaatacaaaacattagctgggcgtggtggcgcatgcctgtagtctcaggtactcggaagggtgaggcacaagaatcgcttgagtctggaaggtggaggttgcagtgagccgagaacacgccactaaactccagccggggtgacagagcaagactctgtctcaaaaaacaaacaaacaattaattacagaaaggtaagcctggccaataggtcaggaaaagcagccccactgcagatccacaccactacggaaacttgaggcaccacacacatgactttgctgactgggggcaaaggatgaactagtgagcaaacttgggaggctgagacaggaggatcgcttgaacctgggaggtagaggttgcagtgagccaagatcgcaccactgctctccagccaggtgacagagcgagactccagctcaaaaaaaaaaaaaaagtcaagatattaaatatgaaagcaacactttattttttattttattttattttaagacagggtctctctctgtcacccagactggagtacagtgacatgatctctgctcactgtgatctctgcctcccaggctcaaactatcctcccacatcagcctcccaaatagctgggactacaggggcccaccaccacacctgactaatttttgtatttttggtagagatgcggtttcaccatgttgcccagcctgatcttgaacttctggattcaagtgatccgccctcctcggcctcccaaagtgctgggactacaggcttgagccacctcgcccagctgaaagtgacactttaatactttcaggaaattataggagatgattgttaagagctcaggataaagagaagtttctggccgggaacggtggctcacacctgtaatcccagcactttcagtggcggagcacctgtggccaagagtttgagaccagcctggccaacatggtgaaaccccatctctactaaaaatacaaaaattgaggtgccgctgttgctgctcgtgttaaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctatgatgagcatgtatcctctcgatcacatacagaagaggattgcacggaggagctctttgacttcttgcatgcaaaggaccattgcgtggcccacaaactctttaacaacttgaaataaatgtgtggacttaattcaccccagccttcatcatctgggcatcagaatatttccttatggtttcggatgtaccatttgtttcttatttgtgtaactgtaagttcacatgaacctcgtgggttttggcttaggctggtagcttctatgtaattcgcagtgattccatctaaataaaagttctgtgatctgcaaaaaaaaaaaaaaa

SEQ ID NO: 196934 - DNA, 586 bp, Homo sapiens
  Payload ID: 18844
  Gene Name: ubiquinol-cytochrome c reductase, complex III subunit VII, 9.5kDa
  Uniprot ID: O14949
  ENST ID: ENST00000378665
  CDS Start-End: 237-485
gagtcaaccggatcggtgactgtggagggcgagctgagccctgtgcgtgagtggggtctggttgtgcagtgttcgtggaccctgggaggctaggggcgccccgctgggctgggaaaggataaggagtgcaggggcaggagtctggggttggggatggacccccgcggggactgcggcgcttcgcgaaagcgagccaagcgcctgtccaccctcggtcctgcagggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtc

SEQ ID NO: 196935 - DNA, 429 bp, Homo sapiens
  Payload ID: 18844
  Gene Name: ubiquinol-cytochrome c reductase, complex III subunit VII, 9.5kDa
  Uniprot ID: O14949
  ENST ID: ENST00000378667
  CDS Start-End: 76-324
gccggaaatgacgaacgagtcaaccggatcggtgactgtggagggcgagctgagccctgtgcggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgca

SEQ ID NO: 196936 - DNA, 839 bp, Homo sapiens
  Payload ID: 18844
  Gene Name: ubiquinol-cytochrome c reductase, complex III subunit VII, 9.5kDa
  Uniprot ID: O14949
  ENST ID: ENST00000378670
  CDS Start-End: 142-390
cttagagacagtaggaaaatggtatctcccggaagttacctcacgacctccaagagcggcttccaaccttgccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcactgttgtgatattacatttttgtgagtagaatcctgtgtgaccactaatattcaagttcatgaagcgcccctcctcagcatgagtcttgaagttttgcctggtctcgggttttggtgaaagagcagggctccccctttgttccattatctacaagaaagtagctgcaggtactcctgcatctaaccatttgtgggtgacatgggctatggcgagtgctggttcttggccctctgctcccatagcaacaataaagtctactaactatattgtaattagtatgtgtcagggacgcttttattttttattttttgagatggagtcttgctctctcacccaggctgga

SEQ ID NO: 196937 - DNA, 916 bp, Homo sapiens
  Payload ID: 18845
  Gene Name: ubiquinol-cytochrome c reductase, complex III subunit X
  Uniprot ID: Q9UDW1
  ENST ID: ENST00000330029
  CDS Start-End: 31-222
gcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgcaaacaccccaaaggcagaatctgctattttgagttttccattaacttccaaagaattctggttttcaaaacaggagccagagttggagatattacagtcaactttggcttctaagccagtaattccattcttaaatacctcactgtcttggccatggggaagcactatggcctcagctgggggaaagaccctggcctaggggtcttagccactccccaccctagggtatagttcaggggtatccaatcctttggcttccctgggccatgttggaagaattgtcttgggccacacataaaatacagtaaccatagctgatgagctaaaacaaaaaacaatggtttgtgcaaaaatctcataatgttttaataaagttgaagaatttg

SEQ ID NO: 196938 - DNA, 584 bp, Homo sapiens
  Payload ID: 18845
  Gene Name: ubiquinol-cytochrome c reductase, complex III subunit X
  Uniprot ID: Q9UDW1
  ENST ID: ENST00000401406
  CDS Start-End: 26-214
ggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgc

SEQ ID NO: 196939 - DNA, 885 bp, Homo sapiens
  Payload ID: 18845
  Gene Name: ubiquinol-cytochrome c reductase, complex III subunit X
  ENST ID: ENST00000616603
  CDS Start-End: 1-399
atggcggccgcgacgttgacttcgaaattgtactccctgctgttccgcaggcctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgcaaacaccccaaaggcagaatctgctattttgagttttccattaacttccaaagaattctggttttcaaaacaggagccagagttggagatattacagtcaactttggcttctaagccagtaattccattcttaaatacctcactgtcttggccatggggaagcactatggcctcagctgggggaaagaccctggcctaggggtcttagccactccccaccctagggtatagttcaggggtatccaatcctttggcttccctgggccatgttggaagaattgtcttgggccacacataaaatacagtaaccatagctgatgagctaaaacaaaaaacaatggtttgtgcaaaaatctcataatgttttaataaagttgaagaatttg

SEQ ID NO: 196940 - DNA, 753 bp, Homo sapiens
  Payload ID: 18846
  Gene Name: ubiquinol-cytochrome c reductase, complex III subunit XI
  Uniprot ID: O14957
  ENST ID: ENST00000585671
  CDS Start-End: 65-235
cgcgcctgcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtaagtttcagtgggctgcggtgggtggactgcatgatggccggatggtggccgaagagtgggttctccaggctcccagagccggggcggcagccctcactgctccccctggagagacctgcattcgagagtggggccctgggtgccccttctggcatctccggcccacgggcacagaactgtccgccccgcagccttgggttgtgtgattggggtgtgggcctcgccctccctctggacaatcccagtgagtctttgaggcaaaccttgcttccgtctcagtgggcactgcagcctgaactgggtggggcccatgttacagacagagggggaaggtggaggctggcccacagtggctggacaccccatgagctcttggaagcgcctgtgaggccctggacgcatccacgtgtttctccagcatgccagctgcccccttaaccacagtgcctgtggcatcttcccagtgcccacatgacagtcccacgtg

SEQ ID NO: 196941 - DNA, 1324 bp, Homo sapiens
  Payload ID: 18846
  Gene Name: ubiquinol-cytochrome c reductase, complex III subunit XI
  Uniprot ID: O14957
  ENST ID: ENST00000591899
  CDS Start-End: 82-252
cgcgtgcgcgccgcggccgcgcctgcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaaga

SEQ ID NO: 196942 - DNA, 504 bp, Homo sapiens
  Payload ID: 18846
  Gene Name: ubiquinol-cytochrome c reductase, complex III subunit XI
  Uniprot ID: O14957
  ENST ID: ENST00000589880
  CDS Start-End: 28-198
tcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgatgcgcccgcctcggcctcccaaagtgctgggattagaggcgtgagccactgcacccagcctggaagggacacttctactcaccctgcctcgtctgctctccctccaggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctg

SEQ ID NO: 196943 - DNA, 3475 bp, Homo sapiens
  Payload ID: 18847
  Gene Name: ubiquinol-cytochrome c reductase, Rieske iron-sulfur polypeptide 1
  Uniprot ID: P47985
  ENST ID: ENST00000304863
  CDS Start-End: 424-1248
gcgattactatgtgctggacttcgtcgtagttgagatatattaccatcctaagttaaactataatcgtttattgttatctctaggtcttcctagatgaaatttttaccctaaaggatcgtaaagtcggcccaccggacgtcagtggggtcccctgttcagccctctcgttcttctggggatctctcgggacactgacgaggtggcaccgggacctacaggtgggccgcaagccccgcccccagcgacggcttgtagccccgtcccccgacgcagcgcctctccaagtttgccccgccctgcaggactgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcatcccgctcaggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagatacttgtgaaatctgtaactgactttattttcttgcccaaatatttgcttcctgctttgcgtcagggacgcagattctgcacggtcattgttgggatgaagtaaaattaacgggtcatctaagtgtctatggcattgacagaaacagtagtatctaggtattccttatttaccggacttggtaagagtcctggctatgcatttcctccctactgtgtaagccgtgtgataatctcaacactaatctgtgggaaagagtcctgaatgaggcattagtagctctgagggtttatcttcacgtctggtctgctggtttttctccttaagtgacaggccaggaaattttattagtcccttatgagtgtaaattagtacttaatcctttagtcttaataggcagtgatgggatattacctgagagaaactttccaaaatgagagtgctctgccatttcgttcattttgtgtgtggttcatcatgtccccaaagttcctgcatccactctatcaggaggcagaaagggagcatctgagacctaatactgcctgcatgcagaagtggtcctgctgggtttgtttctgtagtgatgacactttgaatgttttttcctgttgggtttacagtcactcagcacttttcactgtaagatggtgtggaaccagacgcagagcacatcggaattcacatcctattctgcctccaattacacaggtgaaacaagactaaggtccattttcccctgggagttgggagtgggctttgtcctttgagaatcacagtcactttttgatgtgtttgtctttgctgtttagaggtggaccagtcgtgctttactgagtctacctgataatctcatgtacacttttttaaaatggcaaaaatggttaggttgggtctgcccaaagggaactgaccatccaggattccagcctttgatgttaatagctaggtgttgacagaaaaaagaaaatgtcaaactttctatgcttatgagtagatactagtctttgcttcatttttaccattctagaaatgaaattagcatgtgtgataattggtgggacacagaagtattttatattctgtgtctctagatagtggaggcactcttcggattgggggttggaggaagggttggtggcagagttggaatgtgaaacattgagttgtgaggggaacacaggtccacacactaaaaaacctgtgctgccaaaaatgtcaacagcaccccctccctatagagaaatactgataacctatatcacctcccaccctgaagtgataccttgaaattctacatggcagtggaggacagaagtaggaagtttgcaggtctctaggtactcacttagtgccggaattgctatatttggtggctgcttacttcatctttcatatttagagtttgatggtgggatgctgttaaattgtagtagaccatttagtttttaaagaaggctttgttccacaagtgacaggacaagtcaagtcacttcatgctgttttgctgaatggatacggcagacctgtgttaacatttttaccattctgtgaaaacaaaatcctagatagtaggagaaaattacttacagaataaacctgaccagctagcaccctgacatcagatcattaacctactgcattttattggggataattcttgggacaatcttgagagccaagtgttttcattatgctttaaaaagtgttataaaaatggcctttttgaaaatgttgcattatttgttaaagataacatcaaattttctttggtctttctgagcatacctttgtaaaaactttgactcaatctgagtgtatagagggcatttgtcctgactggatcaaaatgtgctttagtaccctcatttttctaaactgtaggaacatactatttaaatatcagaagtaattcttcattctcacagtactaaatttcattttctgt

SEQ ID NO: 196944 - DNA, 2845 bp, Homo sapiens
  Payload ID: 18848
  Gene Name: ubiquitin A-52 residue ribosomal protein fusion product 1
  Uniprot ID: P62987
  ENST ID: ENST00000442744
  CDS Start-End: 59-445
ctttttcttcagcgaggcggccgagctggttggtggcggcggtcgtgcggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttgagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccaccacgcctggctagtttttctgtttttagtagagacagggttttgctatgttggccaggctggtcttgaactactgacctcttgtgatctacctgtcttggccttccaaagtgctaggattacaagcgtaagccacagcgcctggccttgctacatttttttttttttttttttttttacagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattcaataaacagctgctgctcactctcctggtccgtggactctttttgaactgttaacactccccgcaaaggtccgcagcttcattcttcaaagttagcgagaccaggaacc

SEQ ID NO: 196945 - DNA, 572 bp, Homo sapiens
  Payload ID: 18848
  Gene Name: ubiquitin A-52 residue ribosomal protein fusion product 1
  Uniprot ID: P62987
  ENST ID: ENST00000430157
  CDS Start-End: 95-481
gtgctccgtgcgcaagcgctttcggcggcgattaggtggtttccggttccgctatcttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaa

SEQ ID NO: 196946 - DNA, 779 bp, Homo sapiens
  Payload ID: 18848
  Gene Name: ubiquitin A-52 residue ribosomal protein fusion product 1
  Uniprot ID: P62987
  ENST ID: ENST00000595683
  CDS Start-End: 301-687
ggcggccgagctggttggtggcggcggtcgtgcggatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaat

SEQ ID NO: 196947 - DNA, 707 bp, Homo sapiens
  Payload ID: 18848
  Gene Name: ubiquitin A-52 residue ribosomal protein fusion product 1
  Uniprot ID: P62987
  ENST ID: ENST00000599551
  CDS Start-End: 230-616
gagagttttggtgtaattgagaaggaagctaagagtgttgggtgctccagcttggagttagagaggagagaggctgcgacaggaaggcatgtgtgttgtaggggatggcttcccatccaggctggcagcaggagcagcctgtgcagatcaggacctggctgccgtggaagagggtgggaccgccttcagggaagatggatctagcaagatgatgccaaaggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaa

SEQ ID NO: 196948 - DNA, 764 bp, Homo sapiens
  Payload ID: 18848
  Gene Name: ubiquitin A-52 residue ribosomal protein fusion product 1
  Uniprot ID: P62987
  ENST ID: ENST00000596273
  CDS Start-End: 299-685
atcttctttttcttcagcgaggcggccgagctgatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattga

SEQ ID NO: 196949 - DNA, 692 bp, Homo sapiens
  Payload ID: 18848
  Gene Name: ubiquitin A-52 residue ribosomal protein fusion product 1
  Uniprot ID: P62987
  ENST ID: ENST00000599595
  CDS Start-End: 17-403
tcctgcagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactcca

SEQ ID NO: 196950 - DNA, 743 bp, Homo sapiens
  Payload ID: 18848
  Gene Name: ubiquitin A-52 residue ribosomal protein fusion product 1
  Uniprot ID: P62987
  ENST ID: ENST00000595158
  CDS Start-End: 273-659
gagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactgga

SEQ ID NO: 196951 - DNA, 357 bp, Homo sapiens
  Payload ID: 18848
  Gene Name: ubiquitin A-52 residue ribosomal protein fusion product 1
  ENST ID: ENST00000594527
  CDS Start-End: 1-345
gtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaaaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaa

SEQ ID NO: 196952 - DNA, 927 bp, Homo sapiens
  Payload ID: 18848
  Gene Name: ubiquitin A-52 residue ribosomal protein fusion product 1
  ENST ID: ENST00000599256
  CDS Start-End: 738-927
gccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaag

SEQ ID NO: 196953 - DNA, 554 bp, Homo sapiens
  Payload ID: 18848
  Gene Name: ubiquitin A-52 residue ribosomal protein fusion product 1
  Uniprot ID: P62987
  ENST ID: ENST00000596304
  CDS Start-End: 116-502
gttcgccagcatccaagatggcggcagggcggggcccaaggcgcggcgcgaattgtgacgcaggcgtccggcgtgctccgtgcgcaagcgctttcggcggcgattagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctgga

SEQ ID NO: 196954 - DNA, 668 bp, Homo sapiens
  Payload ID: 18848
  Gene Name: ubiquitin A-52 residue ribosomal protein fusion product 1
  Uniprot ID: P62987
  ENST ID: ENST00000598780
  CDS Start-End: 262-648
agcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagagggacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagg

SEQ ID NO: 196955 - DNA, 508 bp, Homo sapiens
  Payload ID: 18848
  Gene Name: ubiquitin A-52 residue ribosomal protein fusion product 1
  ENST ID: ENST00000596272
  CDS Start-End: 1-417
cccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaa

SEQ ID NO: 196956 - DNA, 514 bp, Homo sapiens
  Payload ID: 18848
  Gene Name: ubiquitin A-52 residue ribosomal protein fusion product 1
  Uniprot ID: P62987
  ENST ID: ENST00000597451
  CDS Start-End: 37-423
gtctatcctgcctcccttcctcctgcagacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaa

SEQ ID NO: 196957 - DNA, 2005 bp, Homo sapiens
  Payload ID: 18849
  Gene Name: ubiquitin associated and SH3 domain containing A
  Uniprot ID: P57075
  ENST ID: ENST00000291535
  CDS Start-End: 85-1956
agcctcagccttgcctctccccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccat

SEQ ID NO: 196958 - DNA, 2504 bp, Homo sapiens
  Payload ID: 18849
  Gene Name: ubiquitin associated and SH3 domain containing A
  Uniprot ID: P57075
  ENST ID: ENST00000319294
  CDS Start-End: 32-2017
ggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggcacttccgtttcccgcttctggattttcagccaggtgcctggacatggccctaacctgaggctgagcaatttaactagagcctccttcgtgagccactacatccttcaaaaatactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtca

SEQ ID NO: 196959 - DNA, 1733 bp, Homo sapiens
  Payload ID: 18849
  Gene Name: ubiquitin associated and SH3 domain containing A
  Uniprot ID: P57075
  ENST ID: ENST00000398367
  CDS Start-End: 30-1610
cgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccat

SEQ ID NO: 196960 - DNA, 567 bp, Homo sapiens
  Payload ID: 18849
  Gene Name: ubiquitin associated and SH3 domain containing A
  ENST ID: ENST00000635189
  CDS Start-End: 61-567
aaacaagtcaatgaatgactgaaagaaccagcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatc

SEQ ID NO: 196961 - DNA, 2754 bp, Homo sapiens
  Payload ID: 18849
  Gene Name: ubiquitin associated and SH3 domain containing A
  ENST ID: ENST00000473381
  CDS Start-End: 30-1385
cgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggtatgtttgaggactgtctagtaggaaaggtaacaataacagcaacactgattatggctagcaggcatccagcctgagccctagctacacaccctttgatacagtgttagctttgtctccagtctgctgaggaggctggggcacagagaggttaagcaacttgcccaaggtcacacagcaagaaagtggcaatgtagaggtttgatctaggaatggatgattcaggaagttggcaggaatgaaagaaaggcatggaaagaacaagagaggggaggaaaaatcaacaaccaaggagctccaaggagctcacttttcaaatggaaaaccacatcctctcattcgttggttttatttcaaaatctgtcactttgggcttttgtttcatgtctggcggttctgcttctacgtgactgagtttatgtaaacagaagagaccattgagttcatcgagtcttcatttcctaaattcagaaaatggaatccagagaagcaagttacaccaatggttaactgcagagacccccacggcccactcgcccagggccccactcagagccctccgctgtgtgcagacggccaaactcatcctggaaggtcagtgagaacctcgaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaa

SEQ ID NO: 196962 - DNA, 572 bp, Homo sapiens
  Payload ID: 18849
  Gene Name: ubiquitin associated and SH3 domain containing A
  ENST ID: ENST00000635108
  CDS Start-End: 66-233
cccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctgacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagc

SEQ ID NO: 196963 - DNA, 696 bp, Homo sapiens
  Payload ID: 18849
  Gene Name: ubiquitin associated and SH3 domain containing A
  ENST ID: ENST00000634718
  CDS Start-End: 35-151
gcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgtgagtactgcccagagaccccggggcccagccagtaaggctggtgccagaccctgctgcggcccccggcatggagctgcaggggtgtagggtacggcttcctgccaaagcagtgcaccttgcagggctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacgga

SEQ ID NO: 196964 - DNA, 2095 bp, Homo sapiens
  Payload ID: 18849
  Gene Name: ubiquitin associated and SH3 domain containing A
  ENST ID: ENST00000635325
  CDS Start-End: 66-1631
cccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacagttttcagcacaaaactggagcctgcctgttgaccatgagcctgccttgaggcagagccatcctggaagaacgttctccttccccagctaactgcagctgagccttcctaatccctacgaaagtgccagggcagcagcctctccttctcatccttccaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactga

SEQ ID NO: 196965 - DNA, 6912 bp, Homo sapiens
  Payload ID: 18850
  Gene Name: ubiquitin associated and SH3 domain containing B
  Uniprot ID: Q8TF42
  ENST ID: ENST00000284273
  CDS Start-End: 376-2325
cagcccacaaggctccttttcctttttgatccattcaaaaattactcattgcaaattcccggactgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaggccttttggagtgtgtctttctgtgtgtttaaaaacagtgggaaaatccacaccacactctaagtggacagctcagaataatttagcatatttcctttcacacttaaagttcttaagatgagactgtgtaaatgagagaaagacttgattcagaggaaaaaaatgtgttctctctggactcttgcctagctcacaaggctttggagaattgtcttcctaaatcggggcacctgctacagaagagaatgtttcgttccctctgggtatgcacagctaaggggcctcatttctcccagagggagctgctggcccgctctaaggggtgcaagaggaaggagtgtgcccagaccagctgggggagcattgaaaggacagcttggggatggaatttttttttttttatctccattttccagttaggtagagccaagctgaggaatccttttaagattattagaaaacatgccctgaagagagttgttcttaggttacacatgaaatcctaccgtcactagcccccatacaccagtgttgctggctgaagatacccgcttaaggatgctaacatttaccctggtactgccacattttctctagagcagctggcccttcttgctacagccctatcccccctccttgcttctgtgaaatggggagacaaagcacttttgctctccaaagcacttttggatactcaggaggaaagataagatacatgtttgaagtattcaatcataggagcaaagaacttgcaaaatatgaagtgacttggaattaaccatgttgtagcctaacgtgctactgcatttctaaatcatcaatatttgcttgtctttgcccctagactctagactatgttaactagttaaggatgttacattttgaaaggatgtatgttagatatattatttgcagcaagaagttcattctgtgcaatatggacatgtttgcaaaccataccaagggtcaggttgttgtacacttacagtacgtgtcaaccataatggaacatccacaaatgcatcaattataccagggatgtatagtaagtcagggaactaatataaatgatgacagtcatggctgcactgctacttgtgctgtcgttttgtttgtttttctatgataatttaaaatacataggtagggctactgaggaaatttggagagccacattctgtggtttctcattatacttacttcctgcatttagagggagtttatttaaaagaaataaatgacaatcaaaccaaatcatcagttatcaatgtctgtttaattgtgtgactatctgactgttgatggccacagatgatggtctcctatggtatagttcactctgtagaagatgtatgcaaagtgaaatgccagccctttaaagagacattagttagtgtaaaatggatctttacatgttgcagtaacattgactatgtttcaaaactcagatgcataaaacgtaaggtatataaaaatacatctatgcttgcgtttgaaactacaacttgataacccctagaaagaagaggacatgaaaggatgctggctatatatgttaatgagcaaaaggattatagttgttttgttttgtttttagagacagggtctcactataatgcttagactggtcttgaactcctgggctcaagcgatcctcctgcccctgtctcccaaagtgctaggattacaggtgtgagccaccacacctggcccatagttgtattttttttaggtcacttagaaaaatatgtcatgtattttacattttgagaaacaaatcaatcatggtttcttctagcgttgcgcaaacactgacccagcttctgggtatggaaataaccctgtgatgatgtgttaatataaaatgttgggagggaatattcccaataaaggtcttaagagaaaagtcacattacaagtaatgtaatggctctaccattcattcttctggtatttgtaatgaagtgaatccactgtttaatcagatccataatctttaacagattcaccacaaattttcatgggcgttgagtgctcagaataatgcttgaacacctcaccttgaaactgtagcagtgtgttctgggcagtatctgtaatgtatgaaatagagtctggaataggttatccactccatcttctaggttatcttagttgtatgacgaactgataaatctgtctgactgggctacaatccattgttcttagtccaatatggacactgccttaggcaatggtctatataagcaaaaggagatagagatctgaaataattttccgaataattcaggtggaaaacaagaaagattgtatttctctgctttcatttcaatttcattatttcaaattgcttgtcaaaatggcccaaaagatctgaattcacattaagttccccttgcacacttacctatttaaaaaactaaacttgcactgcaactgagaaattatttgtaaatcatgtggcatctatgtataataaaagaaagagacaactatattactcaatttcatatacatccaaaaagtataggctaatatatataacctgaagttgcagctggttctttttgatctgaagctgatgcttattaaaacaaatgatgtatggggagaggagaaggaagggcaaggaaggaattgacagataagaagcaaatggtttcttgtacagaggaattttgttttaatgtagaaagttatttgaaataaactaggtgaaatgaaattaactaaaggttttaatctgggattgaaagcctgaaagcatttcctgcttctacaagtgtgccacatcaatccggtaatgccccagtgttattcacagacagaactttgtttcctgtgattttaaaataccgcgtctgttcctccatggaccagagtaattggcacattttaatgcataagctgggggtttcattttcccaggctctcttcaccatcactgcattggtagctaggagcttattgcttcaccccagtatggagttcagattacagtgttttccattacatttagattcatagaatctgaatggctgattaaatggccatctgatggctgaaagaggggcgtatttttcactctgtagtgaaaggcttggaggagtttctactttttattttaattatactttaaccaaagaattattttaaagtaaccttatatttaaaagatgattttgcaaaaaataaaaaataaaaaatatgccttctggagtgatgtctgtttggtaaatcattgttgataatttccttgttagtggtatttggaatgcatatagattgtcttgtcattgtgcttaacattaccataagtgtgtcttttccactcaactagctgtattcgtattaaaatgaagtctcttatttcaattacctagtgttgttgggaactaattgaacagctacagtaaaagaagttcctatctcattgcctttgtggaaaggcttccctatgtggtaaaagaaaggcattcctccgtaacctaggcactctgcaagtccagtgtttaatttcaaagcagtgatgaattgctcttttgaaattactctaagtaatccatgtgttagaatacagatgaacctccgtttgatttcacagccttcagcacaggcaactgttactgagtctgcacgaacttagataatgaggtgcagggttatttgcatttaaattgcaatccagcacacgtgtgagaaagaagaggcactagtctaaaaggctgcattgcggggagagatgagacaggcagaggagggtggggtaaagagcgatttaacatctatttaggttaatgttcactttacaaaggtgatgggggatattttgttaggtgatagcagaagcttttcatttttaaacatagaattaaaattggatttgcttctctttaatacttcaacatattgaatttccctaggaaagtgactagctataatgaaaattcaagcgaaaagggaaaaagattgtaaatgcagatgaaataacttcatttttaagtacaaataatagtaggattggtgtatgtaggtttaaaattatagtgatgactagtcgaacttaatatacaatcagttcttgcaaatactttacacttagctgccattacacaacaaattggaattttccagctgttcaactatcatggactctgtacaggatagatgtgtataatggaaaatatgtactgcttctttctttgattgccactcaagatggaaacaccatgccaaggcattttggttatacacagatcattctaaacctgttattttggagaggtgtattggtttctttctcatttataaggctattgtatttttttttgtatgtgattcaggtgtatttatttgaagactatttgtagttataggaaaaccacacctacctgtattgccaaattctttgtaaactctccgtggcacttgtgctttcctggctgagagctctcccctgttgatacagctatggcaccattgtaattacagatgcacctttcaggagcatctccattaaatggttcatagatgatttaataaaaagaaacttctcagttga

SEQ ID NO: 196966 - DNA, 2735 bp, Homo sapiens
  Payload ID: 18851
  Gene Name: ubiquitin associated protein 1
  Uniprot ID: Q9NZ09
  ENST ID: ENST00000297661
  CDS Start-End: 236-1744
aaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggta

SEQ ID NO: 196967 - DNA, 2535 bp, Homo sapiens
  Payload ID: 18851
  Gene Name: ubiquitin associated protein 1
  Uniprot ID: Q9NZ09
  ENST ID: ENST00000359544
  CDS Start-End: 37-1545
ctcagcctcccaagtagctgggactacaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaaggt

SEQ ID NO: 196968 - DNA, 2524 bp, Homo sapiens
  Payload ID: 18851
  Gene Name: ubiquitin associated protein 1
  Uniprot ID: Q9NZ09
  ENST ID: ENST00000379186
  CDS Start-End: 211-1536
gaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacgattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagctgaagcctggcctagttgctgagaggggctggggagatggggcgggagggccagactcagtgctgctgtggagctaggtgcttcccccttcccctgagactggtggactgaactccagtcaagttgagttcaagtgaaagattcttccagggttttattttttcccctcctaacaaagtctcatagtgttaacactggttctgcaatatctctgaggtgcaaagaatgcacttttccctatggggcccagagtttgccttttctgccaggcagtcaccatgcttccctaccccagcctgtttcttttggcttggtttggaccacagtcctctgctacccagggttttagagcccctgctctaggaaacagtttaagaaatcattggccccttcccagcacattgaatgggtaagcagacaggccatgatttagttggccagcactaactccacctctgttctccttgaacagcttcccctccagcccactgctttaggatgacacaatgaataacacctagtcatagaaatcagtctctctggtttgttttgtattatgttgtacatcattaaagatctaaatacaaaggatatacagtcttgaatctaaaataatttgctaactaactattttgattcttcagagagaactactaataaaaatctaaaag

SEQ ID NO: 196969 - DNA, 2029 bp, Homo sapiens
  Payload ID: 18851
  Gene Name: ubiquitin associated protein 1
  Uniprot ID: Q9NZ09
  ENST ID: ENST00000625521
  CDS Start-End: 11-1711
agacgcccaaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcagggactttcagttaccttgatgatgtcccatttaagacaggagacaaattcaaaacaccagctaaagttggtctacctattggcttctccttgcctgattgtttgcaggttgtcagagaagtacagtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctggggaggtggggaagattcgggcatgtgagtgcccccagaactgtcctggctccttccgtattaaacgcatttgcattttgagaagtgtccttcccacttcagccctccggagagactaccctagtctttctggggtgtttatgtcctcagct

SEQ ID NO: 196970 - DNA, 1753 bp, Homo sapiens
  Payload ID: 18851
  Gene Name: ubiquitin associated protein 1
  ENST ID: ENST00000626262
  CDS Start-End: 1-1587
gaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaagaagttgggtgcagattttcatgtatgacttctctttggaaaagaaaaccattgagtgggctgaagagattaagaaaatcgaagaagccgagcgggaagcagagtgcaaaattgcggaagcagaagctaaagtgaattctaagagtggcccagagggcgatagcaaaatgagcttctccaagactcacagtacagccacaatgccacctcctattaaccccatcctcgccagcttgcagcacaacagcatcctcacaccaactcgggtcagcagtagtgccacgaaacagaaagttctcagcccacctcacataaaggcggatttcaatcttgctgactttgagtgtgaagaagacccatttgataatctggagttaaaaactattgatgagaaggaagagctgagaaatattctggtaggaaccactggacccattatggctcagttattggacaataacttgcccaggggaggctctgggtctgtgttacaggatgaggaggtcctggcatccttggaacgggcaaccctagatttcaagcctcttcataaacccaatggctttataaccttaccacagttgggcaactgtgaaaagatgtcactgtcttccaaagtgtccctcccccctatacctgcagtaagcaatatcaaatccctgtctttccccaaacttgactctgatgacagcaatcagaagacagccaagctggcgagcactttccatagcacatcctgcctccgcaatggcacgttccagaattccctaaagccttccacccaaagcagtgccagtgagctcaatgggcatcacactcttgggctttcagctttgaacttggacagtggcacagagatgccagccctgacatcctcccagatgccttccctctctgttttgtctgtgtgcacagaggaatcatcacctccaaatactggtcccacggtcacccctcctaatttctcagtgtcacaagtgcccaacatgcccagctgtccccaggcctattctgaactgcagatgctgtcccccagcgagcggcagtgtgtggagacggtggtcaacatgggctactcgtacgagtgtgtcctcagagccatgaagaagaaaggagagaatattgagcagattctcgactatctctttgcacatggacagctttgtgagaagggcttcgaccctcttttagtggaagaggctctggaaatgcaccagtgttcagaagaaaagatgatggagtttcttcagttaatgagcaaatttaaggagatgggctttgagctgaaagacattaaggaagttttgctattacacaacaatgaccaggacaatgctttggaagacctcatggctcgggcaggagccagctgagaccaggccctgcctaggccctgccgcagaaccaccatccctgggaggccctgcagagcccacctgtggggaaagagaaggggcagcttccggattttcttttgggggttagaaggtcaggtgtggagactgctcgccagtctctgtgagcctaggccctgagctg

SEQ ID NO: 196971 - DNA, 1381 bp, Homo sapiens
  Payload ID: 18852
  Gene Name: ubiquitin associated protein 1-like
  Uniprot ID: F5GYI3
  ENST ID: ENST00000502113
  CDS Start-End: 145-1290
ctgtttggggctcagctaagtgaccacacaggagagcagtgaggccatttgaggcctgagcctggtcctcaggactcgactctctctccctgccatcaagcagcctgccccagccctgccagccatctccacactcctgacagaatgaatgccctcgatggtgttcctttcaagttgcccaagggctttgtgataggcacagagcctctccctgggccagaactcagcgtcccggcctgcggggaagttctgctgggttctatgcacgacttcagcctggagaggacggcactcttctgggtggaggccgccggccagggacccagcccgtaccagtgcggtgacccggggacagcgtcagcccctccagcctggctcttgctagtcagccccgaacatgggctggcgcctgcgcccaccacaatcagagacccggaggccggacaccaggagaggccggaggaggagggtgaggacgaggcagaagcctcctctggcagcgaggaagagccggcccccagcagcctccaaccgggctccccggcgagccccggccccggccgtcgcctgtgctcgctggacgtgctacgcggcgtgcggttggagctggcaggggcgcggcggcggctctccgaggggaagctggtctcccggccccgcgccctcctgcatggcctccgcggccaccgcgcgctgagcctgtgcccgagccctgcgcagtcccccaggtctgcatcacccccggggcccgcgccccagcaccccgccgcccccgcgtcgcccccgcggccctccacggcaggcgccatccccccgctgcggagccacaagcctacggtcgcgtccctcagcccgtacacctgtctgccacctcttgggggggcaccccaacctctcaacccccacaagtcacaccctgatactgcggctgacctgctgtccgccctgagccaggaggagcaagacctcattgggccagtggtcgccctgggatatcccctgcgaagggccatcatagctctgcagaagacagggaggcagagcctgagccagtttctcagctacctcagtgcctgtgaccgcctgttacgtcagggatatgaggaaggcctggtggatgaggccatggagatgttccagttctccgagagccaggcaggggagttcctgcgcctctgggagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacctggcaacccatcctaactgtattattaaaaccaagtaagagt

SEQ ID NO: 196972 - DNA, 640 bp, Homo sapiens
  Payload ID: 18852
  Gene Name: ubiquitin associated protein 1-like
  ENST ID: ENST00000558802
  CDS Start-End: 27-380
ccagccatctccacactcctgacagaatgaatgccctcgatggtgttcctttcaagttgcccaagggctttgtgataggcacagagcctctccctgggccagaactcagcgtcccggcctgcggggaagttctgctgggttctatgcacgacttcagcctggagaggacggcactcttctgggtggaggccgccggccagggacccagcccgtaccagtgcggtgacccggggacagcgtcagcccctccagcctggctcttgctactcaggcccttggagtgcctctctgccctgtctgctgccccggctgctcctcttaccctccctccctctctgcccgcttccggcccagtttctcagctacctcagtgcctgtgaccgcctgttacgtcagggatatgaggaaggcctggtggatgaggccatggagatgttccagttctccgagagccaggcaggggagttcctgcgcctctgggagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacc

SEQ ID NO: 196973 - DNA, 1694 bp, Homo sapiens
  Payload ID: 18852
  Gene Name: ubiquitin associated protein 1-like
  Uniprot ID: F5GYI3
  ENST ID: ENST00000559089
  CDS Start-End: 222-1367
catttatacacgctttgtctgcagggaagttctcctggtaattacaagcactggccccctcaccttttcctttccagctgtttggggctcagctaagtgaccacacaggagagcagtgaggccatttgaggcctgagcctggtcctcaggactcgactctctctccctgccatcaagcagcctgccccagccctgccagccatctccacactcctgacagaatgaatgccctcgatggtgttcctttcaagttgcccaagggctttgtgataggcacagagcctctccctgggccagaactcagcgtcccggcctgcggggaagttctgctgggttctatgcacgacttcagcctggagaggacggcactcttctgggtggaggccgccggccagggacccagcccgtaccagtgcggtgacccggggacagcgtcagcccctccagcctggctcttgctagtcagccccgaacatgggctggcgcctgcgcccaccacaatcagagacccggaggccggacaccaggagaggccggaggaggagggtgaggacgaggcagaagcctcctctggcagcgaggaagagccggcccccagcagcctccaaccgggctccccggcgagccccggccccggccgtcgcctgtgctcgctggacgtgctacgcggcgtgcggttggagctggcaggggcgcggcggcggctctccgaggggaagctggtctcccggccccgcgccctcctgcatggcctccgcggccaccgcgcgctgagcctgtgcccgagccctgcgcagtcccccaggtctgcatcacccccggggcccgcgccccagcaccccgccgcccccgcgtcgcccccgcggccctccacggcaggcgccatccccccgctgcggagccacaagcctacggtcgcgtccctcagcccgtacacctgtctgccacctcttgggggggcaccccaacctctcaacccccacaagtcacaccctgatactgcggctgacctgctgtccgccctgagccaggaggagcaagacctcattgggccagtggtcgccctgggatatcccctgcgaagggccatcatagctctgcagaagacagggaggcagagcctgagccagtttctcagctacctcagtgcctgtgaccgcctgttacgtcagggatatgaggaaggcctggtggatgaggccatggagatgttccagttctccgagagccaggcaggggagttcctgcgcctctgggagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacctggcaacccatcctaactgtattattaaaaccaagtaagagtaacaaagtgatgcatacttattgtaaaaacacaaataataccaagggtgacagttaacagcagcagaatctgctgaaagagttgaaatagttgcctctgcagaggggcagatgggagagccggacggggagctatgttcttcatgcatgcctgtgaaaccacctgatttgactctttacactgtgtgcattagtaaccttgattttaagaaaattaaaacaaataaataatgggca

SEQ ID NO: 196974 - DNA, 4284 bp, Homo sapiens
  Payload ID: 18853
  Gene Name: ubiquitin associated protein 2
  Uniprot ID: Q5T6F2
  ENST ID: ENST00000360802
  CDS Start-End: 114-3473
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 196975 - DNA, 4289 bp, Homo sapiens
  Payload ID: 18853
  Gene Name: ubiquitin associated protein 2
  Uniprot ID: Q5T6F2
  ENST ID: ENST00000379238
  CDS Start-End: 119-3478
gctttgtaagaggcacattggcaggtaacgagcggcggcggcggcagcgggtcttgggtcctccgagagcagcagcgattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 196976 - DNA, 2513 bp, Homo sapiens
  Payload ID: 18853
  Gene Name: ubiquitin associated protein 2
  Uniprot ID: Q5T6F2
  ENST ID: ENST00000379239
  CDS Start-End: 626-1702
atgatgttttatttccaagcacatatctgagttgtatgtgtggacagcactgagactgagtctttccacagctaggactgagtgtctccacatcctttctgaagcctacgaagctcatttatgtgctctgagatacatctattcaagcacataccaaggaaatgctcactgtgcatttggaagtaggtgttggacagttggactgcagatgttaggtgtctgtgtctctccacaacataggcatcaaccccaatctgccttacgttggccgtgagcattggtagagtcagcctgacttggcggaagcacgtctccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatg

SEQ ID NO: 196977 - DNA, 833 bp, Homo sapiens
  Payload ID: 18853
  Gene Name: ubiquitin associated protein 2
  ENST ID: ENST00000421278
  CDS Start-End: 1-833
cgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttg

SEQ ID NO: 196978 - DNA, 1349 bp, Homo sapiens
  Payload ID: 18853
  Gene Name: ubiquitin associated protein 2
  ENST ID: ENST00000412543
  CDS Start-End: 114-1349
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagagaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaactt

SEQ ID NO: 196979 - DNA, 492 bp, Homo sapiens
  Payload ID: 18853
  Gene Name: ubiquitin associated protein 2
  ENST ID: ENST00000488443
  CDS Start-End: 1-354
cataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagcatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagt

SEQ ID NO: 196980 - DNA, 1859 bp, Homo sapiens
  Payload ID: 18853
  Gene Name: ubiquitin associated protein 2
  ENST ID: ENST00000539807
  CDS Start-End: 114-1859
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaaagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccaccagctcagccacagcagagccaatcacagacccaccacacagcccagcagcccttcgtgaatcctgcactgccacctggagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagcccagctccctgcagcccaagtctcaagcctccaaacctgcctacgctctccatactggacaaactaaacccagaagagaggggtgggctggggcaaggcttatcctgggcaggagagaacacacgagcacgtatttgggagcccagtgccctttcctag

SEQ ID NO: 196981 - DNA, 3460 bp, Homo sapiens
  Payload ID: 18853
  Gene Name: ubiquitin associated protein 2
  ENST ID: ENST00000629575
  CDS Start-End: 79-609
acattggcaggtaacgagcggcggcggcggcagcgggtcttgggtcctccgagagcagcagcggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagagaactggcatcaaatactcacaacatagctcaggatctgtcaaacaaaagttcttatggactcaaaggggcttggaagaattctgtggaagagtggacaacagaagactggactgaagatcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctg

SEQ ID NO: 196982 - DNA, 3997 bp, Homo sapiens
  Payload ID: 18854
  Gene Name: ubiquitin associated protein 2-like
  ENST ID: ENST00000271877
  CDS Start-End: 168-3407
aagtgggcgggggaaggcgcgagagcgagcgcgagagggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtgtatgcatggggctttatcaaaaccagctgtggttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgt

SEQ ID NO: 196983 - DNA, 3411 bp, Homo sapiens
  Payload ID: 18854
  Gene Name: ubiquitin associated protein 2-like
  Uniprot ID: Q14157
  ENST ID: ENST00000343815
  CDS Start-End: 107-3058
cccgactaagtgacttaaactcccacctactcctggaataaggagtcaaagcccggataggcgcagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttctttagctaac

SEQ ID NO: 196984 - DNA, 3864 bp, Homo sapiens
  Payload ID: 18854
  Gene Name: ubiquitin associated protein 2-like
  Uniprot ID: Q14157
  ENST ID: ENST00000361546
  CDS Start-End: 43-3306
agtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttca

SEQ ID NO: 196985 - DNA, 1120 bp, Homo sapiens
  Payload ID: 18854
  Gene Name: ubiquitin associated protein 2-like
  ENST ID: ENST00000368504
  CDS Start-End: 70-1120
cccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtgtatgcatggggctttatcaaaaccagctgtggttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtga

SEQ ID NO: 196986 - DNA, 980 bp, Homo sapiens
  Payload ID: 18854
  Gene Name: ubiquitin associated protein 2-like
  ENST ID: ENST00000412596
  CDS Start-End: 139-980
gcggcccggggtgtcagtgtggaggagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagag

SEQ ID NO: 196987 - DNA, 3988 bp, Homo sapiens
  Payload ID: 18854
  Gene Name: ubiquitin associated protein 2-like
  Uniprot ID: Q14157
  ENST ID: ENST00000428931
  CDS Start-End: 168-3431
aagtgggcgggggaaggcgcgagagcgagcgcgagagggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttc

SEQ ID NO: 196988 - DNA, 911 bp, Homo sapiens
  Payload ID: 18854
  Gene Name: ubiquitin associated protein 2-like
  ENST ID: ENST00000437652
  CDS Start-End: 115-911
gagactgaggtaaagttgggagcgcagcggcgttggcggcggcggcggcggcagcggcagcgcggcggggccggtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagagttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaa

SEQ ID NO: 196989 - DNA, 1419 bp, Homo sapiens
  Payload ID: 18854
  Gene Name: ubiquitin associated protein 2-like
  ENST ID: ENST00000428595
  CDS Start-End: 1-1150
tgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagctaccatatttgcagatgattctctgttgccagcgccagcaggaggagcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgg

SEQ ID NO: 196990 - DNA, 678 bp, Homo sapiens
  Payload ID: 18854
  Gene Name: ubiquitin associated protein 2-like
  ENST ID: ENST00000441890
  CDS Start-End: 132-678
gggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtg

SEQ ID NO: 196991 - DNA, 1789 bp, Homo sapiens
  Payload ID: 18854
  Gene Name: ubiquitin associated protein 2-like
  ENST ID: ENST00000433615
  CDS Start-End: 1-1198
tcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgta

SEQ ID NO: 196992 - DNA, 812 bp, Homo sapiens
  Payload ID: 18854
  Gene Name: ubiquitin associated protein 2-like
  ENST ID: ENST00000456325
  CDS Start-End: 110-812
atgcggctagagcctgagaggggagagcgagaaagagcgcgagcgagcgaggcctgggccttgcctgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacga

SEQ ID NO: 196993 - DNA, 3451 bp, Homo sapiens
  Payload ID: 18854
  Gene Name: ubiquitin associated protein 2-like
  Uniprot ID: Q14157
  ENST ID: ENST00000613315
  CDS Start-End: 168-3098
aagtgggcgggggaaggcgcgagagcgagcgcgagagggaaaaggagggagggggtggggaagagggaatcttatatcacgtgacaggggcggcgcggcccggggtgtcagtgtggaggagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagagttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttctttagctaac

SEQ ID NO: 196994 - DNA, 1225 bp, Homo sapiens
  Payload ID: 18855
  Gene Name: ubiquitin B
  Uniprot ID: P0CG47
  ENST ID: ENST00000302182
  CDS Start-End: 393-1082
gtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 196995 - DNA, 1014 bp, Homo sapiens
  Payload ID: 18855
  Gene Name: ubiquitin B
  Uniprot ID: P0CG47
  ENST ID: ENST00000395837
  CDS Start-End: 182-871
gggccttgttgacctgaggggggcgagggcggttggcgcgcgcgcgcgttgacggaaactaacggacgcctaaccgatcggcgattctgtcgagtttacttcgcggggaaggcggaaaagaggtagtttgtgtggtttctggaagcctttactttggaatcccagtgtgagaaaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 196996 - DNA, 1012 bp, Homo sapiens
  Payload ID: 18855
  Gene Name: ubiquitin B
  Uniprot ID: P0CG47
  ENST ID: ENST00000395839
  CDS Start-End: 180-869
gtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggta

SEQ ID NO: 196997 - DNA, 704 bp, Homo sapiens
  Payload ID: 18855
  Gene Name: ubiquitin B
  ENST ID: ENST00000535788
  CDS Start-End: 101-562
atttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggt

SEQ ID NO: 196998 - DNA, 724 bp, Homo sapiens
  Payload ID: 18855
  Gene Name: ubiquitin B
  ENST ID: ENST00000577640
  CDS Start-End: 106-724
gctatgaggaatttggggctcagttgaaaagcctaaactgcctctcgggaggttgggcgcggcgaactactttcagcggcgcacggagacggcgtctacgtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgca

SEQ ID NO: 196999 - DNA, 500 bp, Homo sapiens
  Payload ID: 18855
  Gene Name: ubiquitin B
  ENST ID: ENST00000578706
  CDS Start-End: 222-500
agtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtg

SEQ ID NO: 197000 - DNA, 376 bp, Homo sapiens
  Payload ID: 18855
  Gene Name: ubiquitin B
  ENST ID: ENST00000577958
  CDS Start-End: 246-376
agtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacggagacggcgtctacgtgaggggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcat

SEQ ID NO: 197001 - DNA, 1056 bp, Homo sapiens
  Payload ID: 18855
  Gene Name: ubiquitin B
  Uniprot ID: P0CG47
  ENST ID: ENST00000614404
  CDS Start-End: 222-911
agtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgccccaacttaagtttagaaattacaagtttcagtaatagctgaacctgttcaaaatgttaataaaggtttcgttgcatggtagc

SEQ ID NO: 197002 - DNA, 2688 bp, Homo sapiens
  Payload ID: 18856
  Gene Name: ubiquitin C
  Uniprot ID: P0CG48
  ENST ID: ENST00000339647
  CDS Start-End: 565-2622
ggagggaggggagggagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 197003 - DNA, 582 bp, Homo sapiens
  Payload ID: 18856
  Gene Name: ubiquitin C
  ENST ID: ENST00000535859
  CDS Start-End: 215-582
tattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccgg

SEQ ID NO: 197004 - DNA, 559 bp, Homo sapiens
  Payload ID: 18856
  Gene Name: ubiquitin C
  ENST ID: ENST00000546271
  CDS Start-End: 150-559
agcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcggacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacat

SEQ ID NO: 197005 - DNA, 718 bp, Homo sapiens
  Payload ID: 18856
  Gene Name: ubiquitin C
  ENST ID: ENST00000546120
  CDS Start-End: 19-708
tgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttcccctt

SEQ ID NO: 197006 - DNA, 563 bp, Homo sapiens
  Payload ID: 18856
  Gene Name: ubiquitin C
  ENST ID: ENST00000535131
  CDS Start-End: 115-563
ggcttttctccgtcgcaggacgcagggttcgggcctagggtaggctctcctgaatcgacaggcgccggacctctggtgaggggagggataagtgaggcgtcagtttctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcag

SEQ ID NO: 197007 - DNA, 582 bp, Homo sapiens
  Payload ID: 18856
  Gene Name: ubiquitin C
  ENST ID: ENST00000541272
  CDS Start-End: 74-582
ttctccgtcgcaggacgcagggttcgggcctagggtaggctctcctgaatcgacaggcgccggacctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcga

SEQ ID NO: 197008 - DNA, 627 bp, Homo sapiens
  Payload ID: 18856
  Gene Name: ubiquitin C
  ENST ID: ENST00000540700
  CDS Start-End: 226-627
acttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgac

SEQ ID NO: 197009 - DNA, 3745 bp, Homo sapiens
  Payload ID: 18856
  Gene Name: ubiquitin C
  Uniprot ID: P0CG48
  ENST ID: ENST00000536769
  CDS Start-End: 1578-3635
gttccccagctttagggccacgcccgccctgagatctgccgagtcattgtccttgtcccgcggccccgggagccccccgcgaccggcctgggaggctcagggaggttgaagggggctgagcaaaggaagccccgtcattacctcaaatgtgacccaaaaataaagacccgtccatctcgcagggtgggccagggcgggtcaggagggaggggagggagaccccgactctgcagaaggcgctcgctgcgtgccccacgtccgccgaacgcggggttcgcgacccgaggggaccgcgggggctgaggggaggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttggtgagtagcgggctgctgggctggccggggctttcgtggccgccgggccgctcggtgggacggaggcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctctggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaattggtgttttttttttttttttttttaagtttattttgcatt

SEQ ID NO: 197010 - DNA, 517 bp, Homo sapiens
  Payload ID: 18856
  Gene Name: ubiquitin C
  ENST ID: ENST00000542416
  CDS Start-End: 333-517
gttgctgggcctctgtcccttctccattggtgccagctctgaagcaatcttttctggggcgcctgcaaaggacggatctgtgggtggaacgaactgaaaacggatccagtgactcatcccgattcttgcacattctagcacatcgcattctagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatcca

SEQ ID NO: 197011 - DNA, 622 bp, Homo sapiens
  Payload ID: 18856
  Gene Name: ubiquitin C
  ENST ID: ENST00000540351
  CDS Start-End: 141-622
acgtcacccgttctgttggcttataatgcagggtggggccacctgccggtaggtgtgcggtaggcttttctccgtcgcaggacgcagggttcgggcctagggtaggctctcctgaatcgacaggcgccggacctctgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgac

SEQ ID NO: 197012 - DNA, 1303 bp, Homo sapiens
  Payload ID: 18856
  Gene Name: ubiquitin C
  ENST ID: ENST00000538617
  CDS Start-End: 318-1235
attgtccttgtcccgcggccccgggagccccccgcgaccggcctgggaggctcagggaggttgaagggggctgagcaaaggaagccccgtcattacctcaaatgtgacccaaaaataaagacccgtccatctcgcaggagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaa

SEQ ID NO: 197013 - DNA, 548 bp, Homo sapiens
  Payload ID: 18856
  Gene Name: ubiquitin C
  ENST ID: ENST00000541645
  CDS Start-End: 83-548
ataatgcagggtggggccacctgccggtaggtgtgcggtaggcttttctccgtcgcaggacgcagggttcgggcctaggacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatct

SEQ ID NO: 197014 - DNA, 1172 bp, Homo sapiens
  Payload ID: 18857
  Gene Name: ubiquitin carboxyl-terminal esterase L1 (ubiquitin thiolesterase)
  Uniprot ID: P09936
  ENST ID: ENST00000284440
  CDS Start-End: 145-816
tttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagata

SEQ ID NO: 197015 - DNA, 917 bp, Homo sapiens
  Payload ID: 18857
  Gene Name: ubiquitin carboxyl-terminal esterase L1 (ubiquitin thiolesterase)
  Uniprot ID: P09936
  ENST ID: ENST00000503431
  CDS Start-End: 63-734
ggcccggccgtaccactccgcgctgcgcacggggggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccac

SEQ ID NO: 197016 - DNA, 748 bp, Homo sapiens
  Payload ID: 18857
  Gene Name: ubiquitin carboxyl-terminal esterase L1 (ubiquitin thiolesterase)
  ENST ID: ENST00000505232
  CDS Start-End: 46-516
gtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcggatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctct

SEQ ID NO: 197017 - DNA, 785 bp, Homo sapiens
  Payload ID: 18857
  Gene Name: ubiquitin carboxyl-terminal esterase L1 (ubiquitin thiolesterase)
  ENST ID: ENST00000512788
  CDS Start-End: 33-758
cctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggtcatctttggaatgcatctcttcttaatgacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaa

SEQ ID NO: 197018 - DNA, 1119 bp, Homo sapiens
  Payload ID: 18857
  Gene Name: ubiquitin carboxyl-terminal esterase L1 (ubiquitin thiolesterase)
  ENST ID: ENST00000512419
  CDS Start-End: 67-276
gcctgggcggctccgctagctgtttttcgtcttccctaggctatttctgccgggcgctccgcgaagatgcagctcaagccgatggagatcaaccccgaggtgagcgccaggtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagatagccacagctgattctcattttctttt

SEQ ID NO: 197019 - DNA, 445 bp, Homo sapiens
  Payload ID: 18857
  Gene Name: ubiquitin carboxyl-terminal esterase L1 (ubiquitin thiolesterase)
  ENST ID: ENST00000514924
  CDS Start-End: 272-445
gttttattctaggtagtcacttaaaaacgaacctcggtactggtctgacttaacatggaggaggaattgtctaagagactcgagctttagagtaattgggatggtgaaaggatgggtttccagaaacttcgcccaaaattaaagactccatcaaaaggactgctccatacactcaaggaacacccaccaacaaatcccgtctccacaaccaccagattatctcaccggcgagtgagactgcaaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccag

SEQ ID NO: 197020 - DNA, 827 bp, Homo sapiens
  Payload ID: 18857
  Gene Name: ubiquitin carboxyl-terminal esterase L1 (ubiquitin thiolesterase)
  ENST ID: ENST00000508768
  CDS Start-End: 38-661
tcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcag

SEQ ID NO: 197021 - DNA, 844 bp, Homo sapiens
  Payload ID: 18858
  Gene Name: ubiquitin carboxyl-terminal esterase L3 (ubiquitin thiolesterase)
  Uniprot ID: P15374
  ENST ID: ENST00000377595
  CDS Start-End: 31-723
gtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaa

SEQ ID NO: 197022 - DNA, 824 bp, Homo sapiens
  Payload ID: 18858
  Gene Name: ubiquitin carboxyl-terminal esterase L3 (ubiquitin thiolesterase)
  ENST ID: ENST00000419068
  CDS Start-End: 1-687
acagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgagtcctcctcgccatcctcatcacagcctcattctagccactgcagaacgaaggcctcatcattgtgtcaccatgcatccctgccctgggtcaaacgtaaccatgtaggccctgcaaaggctaccagtccatctctccgtcttcgtcgctggcgacccttcttacgtctaccatctttgggtctccattctgttgcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgt

SEQ ID NO: 197023 - DNA, 1050 bp, Homo sapiens
  Payload ID: 18858
  Gene Name: ubiquitin carboxyl-terminal esterase L3 (ubiquitin thiolesterase)
  ENST ID: ENST00000618773
  CDS Start-End: 258-842
ggcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtgagaggcccgtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgtgttttatgttatttttgctccaggttaaaggtgcaatgctttcctcctcttttcttgtgaaggatttatct

SEQ ID NO: 197024 - DNA, 1534 bp, Homo sapiens
  Payload ID: 18859
  Gene Name: ubiquitin carboxyl-terminal hydrolase L5
  Uniprot ID: Q9Y5K5
  ENST ID: ENST00000367448
  CDS Start-End: 102-1082
cgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatgggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctcggcatggctataatgaacttggttagaacctataaatgtttttgttatgtgagactttttaaccgatgaattcgttgaatacacaccacatttaaaaactgcctaggaggtaatccaaaaatatatagttataaaacttcttgtattatgtaccaaatctctttcttaaaatataaaataaaattatctagtttaagatta

SEQ ID NO: 197025 - DNA, 1507 bp, Homo sapiens
  Payload ID: 18859
  Gene Name: ubiquitin carboxyl-terminal hydrolase L5
  Uniprot ID: Q9Y5K5
  ENST ID: ENST00000367449
  CDS Start-End: 150-1100
acggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctcggcatggctataatgaacttggttagaacctataaatgtttttgttatgtgagactttttaaccgatgaattcgttgaatacacaccacatttaaaaactgcctaggaggtaatccaaaaatatatagttataaaacttcttgtattatgtaccaaatctctttcttaaaatataaaataaaattatctagtttaagatta

SEQ ID NO: 197026 - DNA, 1355 bp, Homo sapiens
  Payload ID: 18859
  Gene Name: ubiquitin carboxyl-terminal hydrolase L5
  ENST ID: ENST00000367450
  CDS Start-End: 1-1107
gcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaaagacgggttttcaccatgttgcccaggctggtctcagactcctgagctcaagccatccgcctgcctcgacctcccaaagtggtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctg

SEQ ID NO: 197027 - DNA, 1346 bp, Homo sapiens
  Payload ID: 18859
  Gene Name: ubiquitin carboxyl-terminal hydrolase L5
  ENST ID: ENST00000367451
  CDS Start-End: 90-1157
cgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaaagacgggttttcaccatgttgcccaggctggtctcagactcctgagctcaagccatccgcctgcctcgacctcccaaagtggtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcata

SEQ ID NO: 197028 - DNA, 1815 bp, Homo sapiens
  Payload ID: 18859
  Gene Name: ubiquitin carboxyl-terminal hydrolase L5
  Uniprot ID: Q9Y5K5
  ENST ID: ENST00000367454
  CDS Start-End: 237-1223
cgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaa

SEQ ID NO: 197029 - DNA, 5327 bp, Homo sapiens
  Payload ID: 18859
  Gene Name: ubiquitin carboxyl-terminal hydrolase L5
  Uniprot ID: Q9Y5K5
  ENST ID: ENST00000367455
  CDS Start-End: 237-1226
cgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatcttctgcttctaatcttcctttgcaagtcagactttaaagaagactttataaagctttcttttttaaaggaagtaacctacttttttctttatcaagaatatttctgaggttgatacatgactttaacattttattatttattgtaaaatcaatttagcataatttattttattagggagaatgtgtacccatcttccagcttcagcacatttttaaggattgtttttaagcttagtaattgtggtattaaatgacttagaactaatggagaaaaacctgataggaaattgatagaaaaacgaatgaaatatttttcatacataatttcagttggaggtaatggaaaatatgtagtctctcagttatttgtgggtaaatatgttttgctgttgatacagtaataattatggagtgttttcaaagccatgatataatttttaaaaatagatttttaaggaaggctcatcttgatctcattcgtttatttcagcttaatttatatattctttcctattgaggcttaaattttgttaagcaatgtgaggattattgtggtaagttgtatttagtaatcaatacagtgtgatactggcactaggattgacaaataaagcaatggaacagaagagagagcctgaaaacagatcaacgtttatatgatcacttgatttcgacaaaggtggcaaaacaattcaacagagaaggaaagtcttttcaacaaatggagccagaatagaatagctgaatatccatatagaaaaaagtgaacaatgaccccctacctcacaaaaatgactttgagatgaatcatagacctaaatgtaatattttaaaagtatgaagctttttaactgaaaacagatgatatttttgtgacttggggggttagccaaaggtttcttaggtcacagaaagcagtaaccataaaagatccaaaattagagctcatcagaattgtcattgaaagtgttaacaaaagtaatatcaaatgacatttgaaaaatatccttgtaaaatgactatattaataggtataaggatttttcttattaatctaataaaattccttaataggaatttccatagcttaagagtggtttattttatctgcatcttctttggtgattgcaaatcccttgtgatacttcatgattacttctgtctgtgaataaagaagtgtgacttgtctgggtgctatatgttgctggtttgaaattaagtcatgaagctagagggtagagaaaatggaagaataaagagcaacccataaatagataaatgctatttggaaagttttttttaaatgatattttatagaaaatcttgctcatttcatatttagtcttttctaaaattttatttaattattgggtaggtgaagtcgcttccattctattttaagccttcaaaatagccaattctaagggatgtacttctgttattatcaacaaaaaccttgccaacagctgcggcactggctactctcaccttatatgtttagttcccaagatagcttgcccttttccgaacagcagtcagctcgactgtgccactaaaacagacaaatatttgctcgggaatcacaaccacggggacttgctcccccagttaggaccatggtacatatttgtgtgtatattatggtgttacatgcagattaatactttcaattaatcctcctagttgcctgtaacgttaacatttcaagatgcatttagatatttttatcctgtaggaggattttgtttatttgagggaaaaaaagggcttttaatgtattctcctcaaaaaccatttagagaaaacagataagtaaaaataaaatttaaattaccatatttctatttacagggatgagcacattaacattttatgtatttagtgatcctttttcctcatgtgtacacatatgtttttgtgtgttagtcttgcttgccctccccatagtctgaaatagttctatgaagtttatattatttttaaacttgatcatatacaaattttcaggaaacaaaccactctagctatttgaagaggaatgcagatttatattgggagttttgaaactacatagtttcttacaaaatcattggaaggtttggaggagcggtttcaagcttaagtctccagagattactcccatccaaacatacagtattggtgtacctagggaactgctcacttttgcaacagtcagggagttcactgttggaactattaatgttagaacatgttgcagtagttgtgttcaaggaatgaggaacctgctgtaacacttaatgactgtgcactggaatgcagaaaagttaaaccttctatgcctaaatgcctaaaacagacaaactggatagttatatttttagaatgatactgcgttttttagagtagtatgaattcctagatcagtcaaacatgcatgttatttagtttgttctttagtatattgttaactggcctaaatccaatgactgacatggtaaagattcaccacttctagcatactgggcactttttatttttgacttgattacattaactttttgaaaactattcagtgatttattcagccaatcttatgaggtacatctgagttgttctagatgctagaggatagtataacaggaaaaagcccctgctctcatggtgagacagataataagtatgtaatacaacttttcaaatagtagtatgaatggtaaaaaaaatagggaaaaggggtgggaggagctgaggtttgatagaatggtcatggaagatcccattaatgagatgtactttaagtagagacctaaatgaagataattttttctctagtactgaactagcactgtacaagtggattgcatataggcatataggcagaacttctctagtactgaactaacactgtacaagtggattgcatataggcatataggcagaaccaatgtgcaataattaagaatattaatttgcaatcatgtttgatggttaaatggtttattaatgttggagtgtcaatatgaaaatgggttgaataaaagatatatggaaatgcctaggactactgctctatttactttttagcttatccatatattttatgtaatatgcttctttgattctttcttgtagcaatgataatataatattgaataaaccataaaaccagtggggaaa

SEQ ID NO: 197030 - DNA, 834 bp, Homo sapiens
  Payload ID: 18859
  Gene Name: ubiquitin carboxyl-terminal hydrolase L5
  ENST ID: ENST00000421683
  CDS Start-End: 61-834
tctcaggccccagcccttccgaatccgctacgggtgctgcaaggcctgggaagagtttcgatgtctctagggtggctagagcgtcctcccgcgctcagtcgcgctgcaggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcag

SEQ ID NO: 197031 - DNA, 785 bp, Homo sapiens
  Payload ID: 18859
  Gene Name: ubiquitin carboxyl-terminal hydrolase L5
  ENST ID: ENST00000443327
  CDS Start-End: 1-550
acagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatgggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataa

SEQ ID NO: 197032 - DNA, 411 bp, Homo sapiens
  Payload ID: 18859
  Gene Name: ubiquitin carboxyl-terminal hydrolase L5
  ENST ID: ENST00000416915
  CDS Start-End: 1-298
taatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagatattctgatataggggaaggattctttaataagttccccaagtgattctaatgcaactggtctgtgtaccacagtttgagaaacactttgagaagacactactaggcaaataaaattttgg

SEQ ID NO: 197033 - DNA, 784 bp, Homo sapiens
  Payload ID: 18859
  Gene Name: ubiquitin carboxyl-terminal hydrolase L5
  ENST ID: ENST00000449480
  CDS Start-End: 1-346
tgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatctt

SEQ ID NO: 197034 - DNA, 1329 bp, Homo sapiens
  Payload ID: 18859
  Gene Name: ubiquitin carboxyl-terminal hydrolase L5
  ENST ID: ENST00000420791
  CDS Start-End: 1-656
cattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaa

SEQ ID NO: 197035 - DNA, 577 bp, Homo sapiens
  Payload ID: 18859
  Gene Name: ubiquitin carboxyl-terminal hydrolase L5
  ENST ID: ENST00000417752
  CDS Start-End: 83-577
aggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggttgccgaggagcccaagtagaagaa

SEQ ID NO: 197036 - DNA, 1087 bp, Homo sapiens
  Payload ID: 18860
  Gene Name: ubiquitin D
  Uniprot ID: O15205
  ENST ID: ENST00000377050
  CDS Start-End: 225-722
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatttaattctgtcttgataccttgttatttatgcaaaaactcctatctcctttcctttatgacaagagagtaagttttaggttgggatcc

SEQ ID NO: 197037 - DNA, 990 bp, Homo sapiens
  Payload ID: 18860
  Gene Name: ubiquitin D
  Uniprot ID: O15205
  ENST ID: ENST00000383547
  CDS Start-End: 225-722
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 197038 - DNA, 990 bp, Homo sapiens
  Payload ID: 18860
  Gene Name: ubiquitin D
  ENST ID: ENST00000383641
  CDS Start-End: 225-722
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcactgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 197039 - DNA, 990 bp, Homo sapiens
  Payload ID: 18860
  Gene Name: ubiquitin D
  Uniprot ID: O15205
  ENST ID: ENST00000421519
  CDS Start-End: 225-722
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatgttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 197040 - DNA, 990 bp, Homo sapiens; identical to SEQ ID NO: 197038
  Payload ID: 18860
  Gene Name: ubiquitin D
  ENST ID: ENST00000429935
  CDS Start-End: 225-722

SEQ ID NO: 197041 - DNA, 990 bp, Homo sapiens; identical to SEQ ID NO: 197038
  Payload ID: 18860
  Gene Name: ubiquitin D
  ENST ID: ENST00000414436
  CDS Start-End: 225-722

SEQ ID NO: 197042 - DNA, 990 bp, Homo sapiens
  Payload ID: 18860
  Gene Name: ubiquitin D
  Uniprot ID: O15205
  ENST ID: ENST00000432676
  CDS Start-End: 225-722
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatataagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttacggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagcca

SEQ ID NO: 197043 - DNA, 1706 bp, Homo sapiens
  Payload ID: 18861
  Gene Name: ubiquitin domain containing 1
  Uniprot ID: Q9HAC8
  ENST ID: ENST00000370664
  CDS Start-End: 337-1020
gcccctgcctggtgccccgagcgagccgggagtagctgcggcggtgcccgccccctctctccgcccctccagcggagctggtctccggccgggcaccgtcgcgggcccccctggcccggccacctgggaccgtgctggggagtctgccacttccctctctcccctggcccgcaaagttttggcggagccatcgctggggctgagcgcgcccccggggggagatcggggagcgcccgatgccgggcggccggagccattgacccgggacgccgccgtccgctgagcagccgaccaccccgccgcctccggtgcatggggactggctgaggagccagcatgggcaactgcgtggggagacagcgccgggagaggccggcagccccgggacacccccgcaagcgagcaggacgcaatgagcccctgaagaaagagcggcttaagtggaagagcgactaccccatgactgacgggcagctgcggagcaaacgggatgagttctgggacacagcgcctgccttcgagggccgcaaggagatctgggatgccctcaaggctgccgcctatgctgctgaagccaacgaccacgagctggcccaggccatcctggatggagccagcatcaccctgcctcatggcaccctctgtgaatgctacgatgagctgggcaatcgctaccagctgcccatctactgcctgtcaccgccggtgaacctgctgctggagcacacggaggaggagagcctggagccccccgagcctccacccagcgtgcgccgtgagttcccgctgaaggtgcgcctgtccacgggcaaggacgtgaggctcagcgccagcctgcccgacacagtggggcagctcaagaggcagctgcacgcccaggagggcatcgagccatcgtggcagcggtggttcttctccgggaagctgctcacagaccgcacacggctccaggagaccaagatccagaaagattttgtcatccaggtcatcatcaaccagcccccaccaccccaggactgatgggcccacggacccctgggaagaggccccgcctggagcactaggcccccaccctgctgctgccttccagtgctgtcattttcttcaggggccctcccctcggtgtggctggtgggtgagccgtgaagggaccctgcctttcagggcactacgcgccaccagttcccggtacccagggagcaggcagccacacacgggccttgcaaccttgtcagagaaaaggcgaacagggccctcaccctgcctgtctcccgaagcaggttcgagccacaagggccaaccaggaggcccctggagcccagatctgtcatctggtgctgccagctgtgctcactctggttttctgctcagggtctgaagcagctgctgtctccctcctctgcccccatcccctggctctcccctgggcacagtgccactcccttggaagggagggaaccacccgtgagccccagggcttgggaagcctgaggcgggcctctgcctctccctgcccccagcacaattggcagagatgaggcgggtggtggacagctgggctgtcgtggcagggtctgcacagggccatgtcctggctgtaacccaggcagtgggaggtctgcagcctggtcatggcctccacagcaggtccctgtggacagacatatctgcatatttatcaataaagccttttgctccttctcgct

SEQ ID NO: 197044 - DNA, 3301 bp, Homo sapiens
  Payload ID: 18862
  Gene Name: ubiquitin domain containing 2
  Uniprot ID: Q8WUN7
  ENST ID: ENST00000393792
  CDS Start-End: 407-1111
ggcgccgcgggccgggggccgatgggtcctggcggacgcgaggcgccggcgcggggctcgcctggactcgggtgtgcggggctgtgagggggcgaggcgggcgctgcggcccgcccgggatgggccagccctggcctggcggggctgagccgaaggcgagggcggcgcgcgggccaggcctgccgggcgggcggcccgggggttgaggtagaagtgggcgcggaggaaggggccgagccaaggcggtgggtggagcggcgaggggggcggaggctgggccgcggcgggcgagcggagcggcgcgcctgtccggagctcggcggtggcgccggaggaggctgcagcggcggcggcggcgggcccggacgagcgtccggaggtggcggacgaggcgccgggggcccccatgggcgggtgtgtgggcgcccagcacgactcctcgggcagcctcaacgagaactcggagggcaccggagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtgcacttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaacctttttgttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtctcttgagtttcaacagatactcagttgaaaagtcgctgtcatcttgctgcataagtattttgaaaggtctgtataacgaagccatttttatatccaggcttagaaggtcactactatatagtaccttcattgatctatctattctgcttggaacttttcatagctaagtataacccccaaatgcatggttcctgggtcaggagacaccaaaatcaattatagctgttcccactcaagttaataaagtaaatgatttcctccactttgcatggaggggtgtaaggaaagcctattttatctgtgcctgggagaactgtgcctattttcagtcttttagaggaaatttcaactcaaaatttttaagtgtgaaagatttactggtgtcacataaacattagcagtgagaccaaataatgaaacattgctttataccttagtgctttccagttcactgttacctctagtcatggtagatgacaattttcctccctcatcttttgtagcaaagaagcaaattaagagccttttgcaagttagattaggggactgaaaaatccagggagataacctgattcttctatactatgactggagtaaagctgccaagagttaggttgaatttggagccttttaaaagttggttccataagtgagaaggggggctaacatgtgaccactgtgcccctgagaatccatgagatggaaaagtacagacaagaaggcacttaacgctgttctcagttggaaaatgtcagccctccacacctgtttggatgtgaagtgcattattaattttaatgacaaaatgaaactgctaattagtttaaatgtaatgtttaaatggtattgaatttcctattgcctgattaaatatatctgtaattgtaacatcatgtttctgagagctttaactacttccttatttttatgcaatcattttaaagattgtggctatatctaatttaaatttgctgatgattgaatctaaattcaagtgaagaccacagcattaatcccaaaggagattttttttatgtttagaggtggagatattagggtaaatcagtatattgctcctgtcatcaaagtttttgttcatttgtgtgccacatcgaatagcagcacttctcaaagtttgtcaactggaaaaaagtgtttaaaactgtttttttcttaagcagatttggtgatgtcatcaatatctatgatatcgattggtaaaaggtctttctttgttgaggatttgagctctctttttaagagtttattttattttaaaggaacatatgctttgaataacaattctctgggcatgtttaactaacctaggtgggaaaaccatggtgctgtttaattgtaaatagattgatataagattggaccagtacttgatgtgtataattttagtatgtagggtttatgtgctttttttaaaaaaaaaaaaaaggttcaatttttctctt

SEQ ID NO: 197045 - DNA, 5110 bp, Homo sapiens
  Payload ID: 18863
  Gene Name: ubiquitin family domain containing 1
  Uniprot ID: O14562
  ENST ID: ENST00000395878
  CDS Start-End: 382-1311
cgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggcttgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaa

SEQ ID NO: 197046 - DNA, 4727 bp, Homo sapiens
  Payload ID: 18863
  Gene Name: ubiquitin family domain containing 1
  ENST ID: ENST00000567212
  CDS Start-End: 28-930
gtgggtgttgtacacaatcatcatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaacaacacaggaaagtgttggataaaggaaaacctgaagatgtgatgccatctgttaagggggcccaggagcgcctgccaacggtaccgctgtccggcatgtacaataaatctggaggaaaagtgagactcacctttaaactagaacaagaccagctgtggattggcactaaagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttgaaagcactttcacctctggcccaggagactgacccaaagtgaaggacattgccgggagaggcctgcagcatccctggatttcagagttctggaactttgttcataaaaaatctatattcaatctgaggtgatgtggtgactgaagccagaggtgatgtactttcaccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggcttgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataatt

SEQ ID NO: 197047 - DNA, 642 bp, Homo sapiens
  Payload ID: 18863
  Gene Name: ubiquitin family domain containing 1
  ENST ID: ENST00000567264
  CDS Start-End: 17-589
gttgtacacaatcatcatggcggcggccggggccccggatggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaaggcccatgatggaaatttatggcagcagttgggtgccgcagagtggaggtgacaactacctg

SEQ ID NO: 197048 - DNA, 1814 bp, Homo sapiens
  Payload ID: 18864
  Gene Name: ubiquitin fusion degradation 1 like (yeast)
  Uniprot ID: Q92890
  ENST ID: ENST00000263202
  CDS Start-End: 131-1054
acttccggtgagcctctggggcgtaccggcttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaacctatgaaggtgactaaattgtctaacatgaagtgttctttctttttcttcatttatcctttcttttcctacatcaattgcataggtgtcagtctttggcctaaaaaaaggctttaaatagacatgtgttctataagtagtggctgtcccactactgtggctgcaatttaagtatttgacaaagaatgtttctatttttattttacatatttttttcaaaaacaccactcagaagaacctgatctgaatgagtttgcacttttattctcatttcatatggacataactggctccttagtgaacctgttcatagtgaaacaactccatggagaagcaaacatgtgaatgttagaatgaacaaatgctaaagagatgttcctctccttcttccctactccccaactcccaattttaatttattaaatcatccaagcttct

SEQ ID NO: 197049 - DNA, 1007 bp, Homo sapiens
  Payload ID: 18864
  Gene Name: ubiquitin fusion degradation 1 like (yeast)
  Uniprot ID: Q92890
  ENST ID: ENST00000399523
  CDS Start-End: 88-888
agcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaagaggaattcccaattatgaatttaaacttggatgaagctggaggcagattcgtcgctttctctggagaaggacagtcattgcgtaaaaagggaagaaagccctaagtgaggactgttggctgattggaaaataataaaagaatcatttgcaaca

SEQ ID NO: 197050 - DNA, 596 bp, Homo sapiens
  Payload ID: 18864
  Gene Name: ubiquitin fusion degradation 1 like (yeast)
  ENST ID: ENST00000447868
  CDS Start-End: 118-596
ctctggggcgtaccggcttggcgcggcggcagcggcagcggcggctgggagagcggtcggcggggtttcttcgttgcattgcctgagaggagcggagtctgccaggtggtgtccatcatgatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaaagacaagtccagcatgaggagtcgacagaaggtgaagccgaccacagtggctatgctggagagctgggcttccgcgctttctctggatctggcaatagactggatggaaagaagaaaggggtagagcccagcccctccccaatcaagcctggagatattaaaag

SEQ ID NO: 197051 - DNA, 670 bp, Homo sapiens
  Payload ID: 18864
  Gene Name: ubiquitin fusion degradation 1 like (yeast)
  ENST ID: ENST00000421968
  CDS Start-End: 101-670
ttggcgcggcggcagcggcagcggcggctgggagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcagggcctaatgacaggtcagatgtggagaaaggagggaagagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgtattagaaaacgcacttaggaactttgcctgtctgaccaccggggatgtgattgccatcaactataatgaaaagatctacgaactgcgtgtgatggagaccaaacccgacaaggcagtgtccatcattgagtgtgacatgaacgtggactttgatgctcccctgggctacaaagaacccgaa

SEQ ID NO: 197052 - DNA, 293 bp, Homo sapiens
  Payload ID: 18864
  Gene Name: ubiquitin fusion degradation 1 like (yeast)
  ENST ID: ENST00000474226
  CDS Start-End: 86-293
ggcggggtttcttcgttgcattgcctgagaggagcggagtctgccaggtggtgtccatcatggccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctgg

SEQ ID NO: 197053 - DNA, 588 bp, Homo sapiens
  Payload ID: 18864
  Gene Name: ubiquitin fusion degradation 1 like (yeast)
  ENST ID: ENST00000494054
  CDS Start-End: 182-588
aagcaggacccttgaccactaaccgcctgtggtcgcgtccgccggtcctgaacgtggctcgcattctgtctcagccggacttgccctccttgacgaaagaaaggaaggtttgtgtccattcacgggtttcccaagtgctggacgcgcaacaggtttccataaacccaaattctctttcaacatgttcgaccaccctattcccagggtcttccaaaaccgcttctccacacagtaccgctgcttctctgtgtccatgctagcagggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggagtttgtggctgatgagggcatctgctacctcccacactggatgatgcagaacttactcttggaagaaggcggcctggtccaggtggagagcgtcaaccttcaagtggccacctactccaaattccaacctcagagccctgacttcctggacatcaccaaccccaaagccgt

SEQ ID NO: 197054 - DNA, 2570 bp, Homo sapiens
  Payload ID: 18865
  Gene Name: ubiquitin interaction motif containing 1
  Uniprot ID: Q96RL1
  ENST ID: ENST00000377227
  CDS Start-End: 134-2293
gggctcgggatgcggggctgggaccctcccgattccggggcggattccggacgccgggaccggccattactggtgccgggttgggcttctccagatgccggggctgggtccttcccaaggttgagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatatatttatgtttgtacgaaatcttatttcaatagatggaaattttaat

SEQ ID NO: 197055 - DNA, 2502 bp, Homo sapiens
  Payload ID: 18865
  Gene Name: ubiquitin interaction motif containing 1
  Uniprot ID: Q96RL1
  ENST ID: ENST00000511320
  CDS Start-End: 111-2270
cggacgcgcgcgcccctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatata

SEQ ID NO: 197056 - DNA, 249 bp, Homo sapiens
  Payload ID: 18865
  Gene Name: ubiquitin interaction motif containing 1
  ENST ID: ENST00000428382
  CDS Start-End: 155-249
actctccgggaggggcgcttcccgacgccaagtcttactgttgctcaggctggaatgcagtggtgcgctctcggctcactgcaacctctcccttctgggttcaagcgattctcgtgcctcagcctcccaagtagctgggattacagacaaaaggatgccacggagaaagaaaaaagttaaagaagtctccgaatctcggaacctggagaagaaggatgtggaaactaccagttctgtcagtgtgaagag

SEQ ID NO: 197057 - DNA, 1334 bp, Homo sapiens
  Payload ID: 18865
  Gene Name: ubiquitin interaction motif containing 1
  Uniprot ID: Q96RL1
  ENST ID: ENST00000510698
  CDS Start-End: 69-1118
ggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagtt

SEQ ID NO: 197058 - DNA, 619 bp, Homo sapiens
  Payload ID: 18865
  Gene Name: ubiquitin interaction motif containing 1
  ENST ID: ENST00000509236
  CDS Start-End: 148-619
gcttattttgctttgctacctctggtacctcagagcgtgtgccgtggattcggaaacctgtcgctgattccgcagcagtgacccccccctcccggagaggctcgtgtggttttggctcatggctctcaccttgctcacgacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggc

SEQ ID NO: 197059 - DNA, 425 bp, Homo sapiens
  Payload ID: 18865
  Gene Name: ubiquitin interaction motif containing 1
  ENST ID: ENST00000507513
  CDS Start-End: 159-425
aacgtgtggcggctcgcgacccccggcaacccggagaaggtctacagagcggcctgcgccagcgagttgaagaaaaaaaacaacaacctaggatcagtttggggagaattgatatgtttactatgttgaagcttccaacctgtgggcatgacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctc

SEQ ID NO: 197060 - DNA, 2467 bp, Homo sapiens
  Payload ID: 18865
  Gene Name: ubiquitin interaction motif containing 1
  ENST ID: ENST00000512031
  CDS Start-End: 75-575
caacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatgcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaat

SEQ ID NO: 197061 - DNA, 1945 bp, Homo sapiens
  Payload ID: 18865
  Gene Name: ubiquitin interaction motif containing 1
  Uniprot ID: Q96RL1
  ENST ID: ENST00000506128
  CDS Start-End: 52-1713
cgcggcccgctactctccgggaggggcgcttcccgacgccaagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacccagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatata

SEQ ID NO: 197062 - DNA, 7761 bp, Homo sapiens
  Payload ID: 18866
  Gene Name: ubiquitin protein ligase E3 component n-recognin 1
  Uniprot ID: Q8IWV7
  ENST ID: ENST00000290650
  CDS Start-End: 80-5329
cctgtctctccgaccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatcttggtgggatcagcaagttgatttttatactgctttcttgcatcatttggcacaattggtgccagaaatttactttgctgaaatggacccagacttggaaaagcaggaggaaagtgtacaaatgtcaatattcactccactggaatggtacttatttggagaagatccagatatttgcttagagaaattgaagcacagtggagcatttcagctttgtgggagggttttcaaaagtggagagacaacctattcttgcagggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagaggtaattgtccaagccaggaaaatatttccttcagtgataaaatatgtcgtagaaatgactatatgggaagaggaaaaagaactgcctcctgaactccagataagggagaaaaatgaaagatactattgtgtccttttcaatgatgaacaccattcatatgaccacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacaggaacaataaattcaacttccagggttatagccaggacaaattgggaagagtatatgcagtaatatgtgacctaaagtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaataatgaaactggcttagagaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattactcatgataaagaaaaagcagaacgaaaaagaaaagctgaagctgctaggctacatcgccagaagatcatggctcagatgtctgccttacagaaaaacttcattgaaactcataaactcatgtatgacaatacatcagaaatgcctgggaaagaagattccattatggaggaagagagcaccccagcagtcagtgactactctagaattgctttgggtcctaaacggggtccatctgttactgaaaaggaggtgctgacgtgcatcctttgccaagaagaacaggaggtgaaaatagaaaataatgccatggtattatcggcctgtgtccagaaatctactgccttaacccagcacaggggaaaacccatagaactctcaggagaagccctagacccacttttcatggatccagacttggcatatggaacttatacaggaagctgtggtcatgtaatgcacgcagtgtgctggcagaagtattttgaagctgtacagctgagctctcagcagcgcattcatgttgacctttttgacttggaaagtggagaatatctttgccctctttgcaaatctctgtgcaatactgtgatccccattattcctttgcaacctcaaaagataaacagtgagaatgcagatgctcttgctcaacttttgaccctggcacggtggatacagactgttctggccagaatatcaggttataatataagacatgctaaaggagaaaacccaattcctattttctttaatcaaggaatgggagattctactttggagttccattccatcctgagttttggcgttgagtcttcgattaaatattcaaatagcatcaaggaaatggttattctctttgccacaacaatttatagaattggattgaaagtgccacctgatgaaagggatcctcgagtccccatgctgacctggagcacctgcgctttcactatccaggcaattgaaaatctattgggagatgaaggaaaacctctgtttggagcacttcaaaataggcagcataatggtctgaaagcattaatgcagtttgcagttgcacagaggattacctgtcctcaggtcctgatacagaaacatctggttcgtcttctatcagttgttcttcctaacataaaatcagaagatacaccatgccttctgtctatagatctgtttcatgttttggtgggtgctgtgttagcattcccatccttgtattgggatgaccctgttgatctgcagccttcttcagttagttcttcctataaccacctttatctcttccatttgatcaccatggcacacatgcttcagatactacttacagtagacacaggcctaccccttgctcaggttcaagaagacagtgaagaggctcattccgcatcttctttctttgcagaaatttctcaatatacaagtggctccattgggtgtgatattcctggctggtatttgtgggtctcactgaagaatggcatcaccccttatcttcgctgtgctgcattgtttttccactatttacttggggtaactccgcctgaggaactgcataccaattctgcagaaggagagtacagtgcactctgtagctatctatctttacctacaaatttgttcctgctcttccaggaatattgggatactgtaaggcccttgctccagaggtggtgtgcagatcctgccttactaaactgtttgaagcaaaaaaacaccgtggtcaggtaccctagaaaaagaaatagtttgatagagcttcctgatgactatagctgcctcctgaatcaagcttctcatttcaggtgcccacggtctgcagatgatgagcgaaagcatcctgtcctctgccttttctgtggggctatactatgttctcagaacatttgctgccaggaaattgtgaacggggaagaggttggagcttgcatttttcacgcacttcactgtggagccggagtctgcattttcctaaaaatcagagaatgccgagtggtcctggttgaaggtaaagccagaggctgtgcctatccagctccttacttggatgaatatggagaaacagaccctggcctgaagaggggcaacccccttcatttatctcgtgagcggtatcggaagctccatttggtctggcaacaacactgcattatagaagagattgctaggagccaagagactaatcagatgttatttggattcaactggcagttactgtgagctccaactctgcctcaagacaatcacaaatgacgacagtagtaaaggctgattcaaaattatggaaaactttctgagggctgggaaagtattggagggtcttttgctccatgtccaggttcacttacatcaataaaatatttcttaatggagtattgctttcaattagcaaacatatgcttcacaggaaaaaaggacatagatcaatctgttttatgtgctagtatttccaggaatttattccccttcataatttgtctcatttcattttatttcatccacttggtagatgaagtcacgtcaaacagttgtagacattttatatgttggttaactcttctgcaattttgtatttggtgttttccccccaagtttagttcaactgacattggatcactgacaaaattctaataatctgtgatagtcttccttgcagttaaagaagaattgcagaaaccatgcaatatacttgggaaagattccaaaaataaattttttattatttctcttttaaggaaatacccctaatgtgccacctgctgctatcaccacaaattaaactcaatctctatgtggacagaggatgatttctgccaatatggaaaagcttttttctcactgtaggcctcaagaaaagttagggtaatgtatttgttattcattcctgacggtacaaagagcttgcagttctcacctctgactaccagtagctttgttgagttttgaaataatacttgacattttccaaaggcaaatctcattctgcaaggagattgtggcaccatcctgtttgactctcagaaacctcttgtaattctgatgtaaaaactgtagaatgaagatgagaaaattctcgcaatgagtggatcatgacaactgtaaattagaacaatcagatttaaaccaattccgcagtcttctatatctttgtaaaagacaaatccttgatgttgtctgtgtgcaaccttttcataaactctggttttatgactagtacaaaccaccaaaaaagccatgtgatcaatagtctgtgtcctgttataacatgctgtggttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttttctaatgtttggtaaggggctagtgagaattttaatgatatggtgaagaaaaatatatctgtataattaatttattatattggtgtatgggctgtgagttcaccttttagtggtcatttgtcatttcataacaactatgcattttggttcactgtgatgatgatctatatttagtgactgcaacatgtttataccactgattcaaattccatccatgatgaagttatacaaataatgcatatattgataacttttattgcaaaaatgtaaatttaaaacttgtataatgttcttgtgctttttaaaataaaatatatgtgtatatttaaaaagaaaaa

SEQ ID NO: 197063 - DNA, 549 bp, Homo sapiens
  Payload ID: 18866
  Gene Name: ubiquitin protein ligase E3 component n-recognin 1
  ENST ID: ENST00000569337
  CDS Start-End: 86-274
gtcgtccctgtctctccgaccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatctatggggtctcactgtgttgcccaggctggagtgcagtggcatgatctccgctcactgacctctccctctctgactcaagcaattctcccacctcagcctcccgaatagctgggaccacagtggtgggatcagcaagttgatttttatactgctttcttgcatcatttggcacaattggtgccagaaatttactttgctgaaatggacccagacttggaaaagcaggaggaaagtgtacaaatgtcaatattcactccactggaatggtacttatttggagaagatccagatatttgcttagagaaattgaagcacagtggagcatttcagctttgtgggagggttttcaaaagtggagagacaacctattcttgcagggattg

SEQ ID NO: 197064 - DNA, 721 bp, Homo sapiens
  Payload ID: 18866
  Gene Name: ubiquitin protein ligase E3 component n-recognin 1
  ENST ID: ENST00000569971
  CDS Start-End: 1-219
caacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaagtattataaacaactgcagaaagaatatatcagtgatgatcatgacagaagtatctctataactgcactttcagttcagatgtttactgttcctactctggtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctgg

SEQ ID NO: 197065 - DNA, 2250 bp, Homo sapiens
  Payload ID: 18866
  Gene Name: ubiquitin protein ligase E3 component n-recognin 1
  ENST ID: ENST00000569066
  CDS Start-End: 1-447
gttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaccaggtgtatcaggccatggagtttatgaactaaaagatgaatcactgaaagacttcaatatgtacttttatcattactccaaaacccagcatagcaaggtagaaaaaagtatccttttcagtaaataaacctaaatgctttatgctttctaactccacagaaaattttctgctttttctatagtttcacgctggttcttattaatagaggtcattatgtcacccaagaattaaaattgaatcaataatcttatctagtatacaggcaatattcagattttcctgattatactacatatgtctttaatagctgttttgggaagaggattcaatcaagcatcatggacttcatcatcacacactcatttgattgtcatgtttctttagtttttgttttgttttgttttttgtttttgtttttgttttgtgaaatggagcctcactctgttgtccaggctggaacgtagttgcacgatatcagctcactgcaacctccacctcccaggttcaagtgattctcctgccccagcatcctgagtagctgggactataggcacatgccaccatgcctggctaatttttgtatttttagtaaagaccgggtttcaccatgttgtccaggctggtctcaaattcctgacctcaaatgattccacccacctcggcctcccaacgtcctgggattacaggcgtgagccacctcgcccggccaatagtttcctttaatttagaagataattcttttgcatttttttcttttgtaacatcggcatttctatagagtaccaaatagattcagcttaaacagtttttggcaagaatactatgtaaatgatatattgcatcccattattaggcacatacgtctttttgtcccatgaaggatcatgttaagtttgatcagttagttaaggtgatgtctggctttgtccttatcaagtaaatactttacagcccatagcatagtaccctgtgcataataggtactgggtaaatattttcagtagaaaataatggagactaagtttttgatcagggatattcctcatctattttgcattaggtttctctagaacacaattttatttctaggacaaagaggcattttgaatacatgcttcagtatataaagtattttaataggtggttgggtctttcctgactgctttaatgtatttcatttgtttcatgcttccaaagcagtatatttaatgatagatttttttataggctgaacatatgcagaagaaaaggagaaaacaagaaaacaaagatgaaggtaaaaacattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcaggtaaactaaaaaagtaaagtgatcatatcttggtttaaatatttaagaattctctgcttgcctccagtgttaaaccactgtaccattgtagacatttactactggttttcataatcacttatttttcatgttaataattctattttcctatattttattgtagttttaaaaataaactaagatttattca

SEQ ID NO: 197066 - DNA, 545 bp, Homo sapiens
  Payload ID: 18866
  Gene Name: ubiquitin protein ligase E3 component n-recognin 1
  ENST ID: ENST00000563239
  CDS Start-End: 67-162
ccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatctggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggt

SEQ ID NO: 197067 - DNA, 702 bp, Homo sapiens
  Payload ID: 18866
  Gene Name: ubiquitin protein ligase E3 component n-recognin 1
  ENST ID: ENST00000569243
  CDS Start-End: 1-517
gaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcaggtaaactaaaaaagtaaagtgatcatatcttggtttaaatatttaagaattctctgcttgcctccagtgttaaaccactgtaccattgtagacatttactactggttttcataatcacttatttttcatgttaataattctattttcctatattttattgtagttttaaaaataaactaagatttattcatttt

SEQ ID NO: 197068 - DNA, 735 bp, Homo sapiens
  Payload ID: 18866
  Gene Name: ubiquitin protein ligase E3 component n-recognin 1
  ENST ID: ENST00000564540
  CDS Start-End: 1-214
gaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaaggtaaaaacattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcaggtaaactaaaaaagtaaagtgatcatatcttggtttaaatatttaagaattctctgcttgcctccagtgttaaaccactgtaccattgtagacatttactactggttttcataatcacttatttttcatgttaataattctattttcctatattttattgtagttttaaaaataaactaagatttattca

SEQ ID NO: 197069 - DNA, 3332 bp, Homo sapiens
  Payload ID: 18866
  Gene Name: ubiquitin protein ligase E3 component n-recognin 1
  ENST ID: ENST00000546274
  CDS Start-End: 92-3304
aaaagtgtcgtccctgtctctccgaccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatcttggtgggatcagcaagttgatttttatactgctttcttgcatcatttggcacaattggtgccagaaatttactttgctgaaatggacccagacttggaaaagcaggaggaaagtgtacaaatgtcaatattcactccactggaatggtacttatttggagaagatccagatatttgcttagagaaattgaagcacagtggagcatttcagctttgtgggagggttttcaaaagtggagagacaacctattcttgcagggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagaggtaattgtccaagccaggaaaatatttccttcagtgataaaatatgtcgtagaaatgactatatgggaagaggaaaaagaactgcctcctgaactccagataagggagaaaaatgaaagatactattgtgtccttttcaatgatgaacaccattcatatgaccacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacaggaacaataaattcaacttccagggttatagccaggacaaattgggaagagtatatgcagtaatatgtgacctaaagtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaataatgaaactggcttagagaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattactcatgataaagaaaaagcagaacgaaaaagaaaagctgaagctgctaggctacatcgccagaagatcatggctcagatgtctgccttacagaaaaacttcattgaaactcataaactcatgtatgacaatacatcagaaatgcctgggaaagaagattccattatggaggaagagaggtaaaataaagcaaaccaaaaattaccaactc

SEQ ID NO: 197070 - DNA, 189 bp, Homo sapiens
  Payload ID: 18866
  Gene Name: ubiquitin protein ligase E3 component n-recognin 1
  ENST ID: ENST00000627960
  CDS Start-End: 1-189
atggcggacgaggaggctggaggtactgagaggatggaaatcagcgcggagttaccccagacccctcagcgtctggcatctatggggtctcactgtgttgcccaggctggagtgcagtggcatgatctccgctcactgacctctccctctctgactcaagcaattctcccacctcagcctcccgaatag

SEQ ID NO: 197071 - DNA, 7857 bp, Homo sapiens
  Payload ID: 18867
  Gene Name: ubiquitin protein ligase E3 component n-recognin 2
  Uniprot ID: Q8IWV8
  ENST ID: ENST00000372899
  CDS Start-End: 259-5526
ttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggagattgcggggaaatggctgcaagcaactgacctcactagagaagtgtaccagcatttagcccactatgtacccaaaatctactgcaggggtcccaacccttttccacagaaagaagacatgctggcacagcatgttttgttgggaccaatggaatggtacctttgtggtgaagatcctgcatttggatttccaaaacttgagcaagcaaacaaaccttctcatctttgtggtcgtgtttttaaagtaggagagcctacatattcttgcagagactgtgcagttgatccaacttgtgttttgtgcatggagtgctttttgggaagtattcacagagatcatcgatataggatgacaacatcaggaggtggaggtttctgtgactgtggtgatactgaagcctggaaagagggtccttactgtcaaaaacatgaacttaacacctctgaaattgaggaagaagaggatcctcttgttcatttatcagaagatgtgatagcaagaacttataacatttttgctattacgtttcggtatgcagtagaaatattaacctgggaaaaagaaagtgaattgccagcagatttagagatggtagagaagagtgacacctactattgcatgctgtttaatgatgaggttcacacctatgaacaagttatttatactcttcagaaagctgttaactgtacacaaaaagaagctattggttttgcaactacagtagatcgagatgggcgtaggtctgttcgatatggagattttcagtattgtgagcaagcaaaatcagtaattgtgagaaataccagtagacagacaaagccactcaaagttcaagttatgcattcgtctattgtcgcacatcagaattttggtttgaaacttttgtcttggctgggaagtattattggatattcagatggccttcgccggattttatgtcaagttggtttacaagaagggccagatggtgaaaactcttctctagtggacagactgatgcttagtgattccaaattatggaaaggtgctaggagtgtatatcatcagttgttcatgagcagtctgcttatggatttgaaatacaagaaactatttgctgttcgatttgcaaaaaattaccagcagttgcagagagattttatggaggatgatcacgagcgagcagtgtcggtgactgctctatctgtccagttcttcaccgcacctactctggctcgaatgctcatcacagaagaaaacttaatgagcattatcattaagacttttatggatcatttgagacatcgagatgcccagggcagatttcagtttgaacgatacactgctttacaagccttcaaatttaggagagtacagagccttattttagatctcaagtatgtgttaattagcaaaccaactgaatggtcagatgagctgaggcagaagttcctagaagggtttgatgcctttttggaattactaaaatgtatgcagggaatggatccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccgcacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttttctttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatt

SEQ ID NO: 197072 - DNA, 7857 bp, Homo sapiens
  Payload ID: 18867
  Gene Name: ubiquitin protein ligase E3 component n-recognin 2
  Uniprot ID: Q8IWV8
  ENST ID: ENST00000372901
  CDS Start-End: 259-5526
ttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggagattgcggggaaatggctgcaagcaactgacctcactagagaagtgtaccagcatttagcccactatgtacccaaaatctactgcaggggtcccaacccttttccacagaaagaagacatgctggcacagcatgttttgttgggaccaatggaatggtacctttgtggtgaagatcctgcatttggatttccaaaacttgagcaagcaaacaaaccttctcatctttgtggtcgtgtttttaaagtaggagagcctacatattcttgcagagactgtgcagttgatccaacttgtgttttgtgcatggagtgctttttgggaagtattcacagagatcatcgatataggatgacaacatcaggaggtggaggtttctgtgactgtggtgatactgaagcctggaaagagggtccttactgtcaaaaacatgaacttaacacctctgaaattgaggaagaagaggatcctcttgttcatttatcagaagatgtgatagcaagaacttataacatttttgctattacgtttcggtatgcagtagaaatattaacctgggaaaaagaaagtgaattgccagcagatttagagatggtagagaagagtgacacctactattgcatgctgtttaatgatgaggttcacacctatgaacaagttatttatactcttcagaaagctgttaactgtacacaaaaagaagctattggttttgcaactacagtagatcgagatgggcgtaggtctgttcgatatggagattttcagtattgtgagcaagcaaaatcagtaattgtgagaaataccagtagacagacaaagccactcaaagttcaagttatgcattcgtctattgtcgcacatcagaattttggtttgaaacttttgtcttggctgggaagtattattggatattcagatggccttcgccggattttatgtcaagttggtttacaagaagggccagatggtgaaaactcttctctagtggacagactgatgcttagtgattccaaattatggaaaggtgctaggagtgtatatcatcagttgttcatgagcagtctgcttatggatttgaaatacaagaaactatttgctgttcgatttgcaaaaaactatgagcgtttgcagagtgattatgtgacagatgaccacgacagagagttttcagtcgcagacctctcggttcagatattcacggttccttcacttgctcgaatgctcatcacagaagaaaacttaatgagcattatcattaagacttttatggatcatttgagacatcgagatgcccagggcagatttcagtttgaacgatacactgctttacaagccttcaaatttaggagagtacagagccttattttagatctcaagtatgtgttaattagcaaaccaactgaatggtcagatgagctgaggcagaagttcctagaagggtttgatgcctttttggaattactaaaatgtatgcagggaatggatccaattacacgtcaagtaggacaacatattgaaatggaaccagagtgggaagcagccttcacactacaaatgaaattaacacatgtcatttcaatgatgcaggactggtgtgcttcagatgaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtttacatgtattattaagcaaaagtgaagtggcatataaatttccagagctcctacctctaagtgaacttagcccacccatgttgatagaacaccctcttagatgtcttgttctgtgtgcccaagtacatgccggaatgtggagaagaaatgggttctctctagtaaaccagatttattactaccataatgtgaaatgcagacgtgagatgtttgacaaggatgtagtaatgcttcagacaggtgtctccatgatggatccaaatcatttcctgatgatcatgctcagccgctttgaactttatcagattttcagtactccagactatggaaaaagatttagttctgagattacccataaggatgttgttcagcagaacaatactctaatagaagaaatgctatacctcattataatgcttgttggagagagatttagtcctggagttggacaggtaaatgctacagatgaaatcaagcgagagattatccatcagttgagtatcaagcctatggctcatagtgaattggtaaagtctttacctgaagatgagaacaaggagactggcatggagagtgtaatcgaagcagttgcccatttcaagaaacctggattaacaggacgaggcatgtatgaactgaaaccagaatgtgccaaagagttcaacttgtatttctatcacttttcaagggcagaacagtccaaggcagaagaagcgcaacggaaattgaaaagacaaaatagagaagatacagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtgttacatttaattggcatggcactacaagaagaaaaacaacatttagagaatgtcacggaagagcatgtagtaacatttaccttcactcagaagatatcaaaacctggtgaagcgccaaaaaattctcctagcatactagctatgctggaaacactacaaaatgctccctacctagaagtccacaaagacatgattcggtggatattgaagacttttaatgctgttaaaaagatgagggagagttcacctaccagtcccgtggcagagacagaaggaaccataatggaagagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcatagccctgtggcttcagatatgacacttacagcactgggccccgcacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccagaaaaatatgatccattattcatgcaccctgatctgtcttgtggaacacacactagtagctgtgggcacattatgcatgcccattgttggcaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaacaggttaaatttttcagaccaaccaaatctgactcagtggattagaacaatatctcagcaaataaaagcattacagtttcttaggaaagaagaaagtactcctaataatgcctctacaaagaattcagaaaatgtggatgaattacagctccctgaagggttcaggcctgattttcgtcctaagatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcatagaaagaattttgagtgatgaagataaaccattgtttggtcctttaccttgcagactggatgactgtcttaggtcattgacgagatttgccgcagcacactggacagtggcatcagtttcagtggtgcaaggacatttttgtaaactttttgcatcactggtgcctaatgacagccatgaggaacttccatgcatattagatattgacatgtttcatttattggtgggcttggtgcttgcatttcctgcgttgcagtgtcaggatttttcagggatcagccttggcactggagaccttcacattttccatctggttactatggcacacatcatacagatcttacttacctcatgtacagaagagaatggcatggatcaagaaaatcccccttgtgaagaagaatcagcagttcttgctttgtataaaacacttcaccagtatacgggaagtgccttgaaagaaataccatccggctggcatctgtggaggagtgtcagagctggaatcatgcctttcctgaagtgttctgctttattttttcattacttaaatggagttccttccccacccgacattcaagttcctggaacaagccattttgaacatttatgtagctatctttccctaccaaacaacctcatttgcctttttcaagaaaatagtgagataatgaattcactgattgaaagttggtgccgtaacagtgaagttaaaagatatctagaaggtgaaagagatgctataagatatccaagagaatctaacaaattaataaaccttccagaggattacagcagcctcattaatcaagcatccaatttctcgtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgagagtacgggaatgtcaggtgctatttttagctggcaaaaccaaaggctgtttttattctcctccttaccttgatgactatggggagaccgaccagggactcagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttttctttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatt

SEQ ID NO: 197073 - DNA, 2423 bp, Homo sapiens
  Payload ID: 18867
  Gene Name: ubiquitin protein ligase E3 component n-recognin 2
  Uniprot ID: Q8IWV8
  ENST ID: ENST00000372903
  CDS Start-End: 259-1578
ttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggagattgcggggaaatggctgcaagcaactgacctcactagagaagtgtaccagcatttagcccactatgtacccaaaatctactgcaggggtcccaacccttttccacagaaagaagacatgctggcacagcatgttttgttgggaccaatggaatggtacctttgtggtgaagatcctgcatttggatttccaaaacttgagcaagcaaacaaaccttctcatctttgtggtcgtgtttttaaagtaggagagcctacatattcttgcagagactgtgcagttgatccaacttgtgttttgtgcatggagtgctttttgggaagtattcacagagatcatcgatataggatgacaacatcaggaggtggaggtttctgtgactgtggtgatactgaagcctggaaagagggtccttactgtcaaaaacatgaacttaacacctctgaaattgaggaagaagaggatcctcttgttcatttatcagaagatgtgatagcaagaacttataacatttttgctattacgtttcggtatgcagtagaaatattaacctgggaaaaagaaagtgaattgccagcagatttagagatggtagagaagagtgacacctactattgcatgctgtttaatgatgaggttcacacctatgaacaagttatttatactcttcagaaagctgttaactgtacacaaaaagaagctattggttttgcaactacagtagatcgagatgggcgtaggtctgttcgatatggagattttcagtattgtgagcaagcaaaatcagtaattgtgagaaataccagtagacagacaaagccactcaaagttcaagttatgcattcgtctattgtcgcacatcagaattttggtttgaaacttttgtcttggctgggaagtattattggatattcagatggccttcgccggattttatgtcaagttggtttacaagaagggccagatggtgaaaactcttctctagtggacagactgatgcttagtgattccaaattatggaaaggtgctaggagtgtatatcatcagttgttcatgagcagtctgcttatggatttgaaatacaagaaactatttgctgttcgatttgcaaaaaactatgagcgtttgcagagtgattatgtgacagatgaccacgacagagagttttcagtcgcagacctctcggttcagatattcacggttccttcacttttctctatctctgctgggcgcagtggctcacctctgtaatcctagccaaggcaggtggatcacctgagcttaggagtctgagaccagcctggccaacatggtgaaaccccatctctactaaaaatagaaaaattagccaggcgtggtggcgcacgcctgaggctgaggcagaagaatcacttgaacccaagaggcggaggttgcagtgagctgagatcaagccattgcactccagcctgggcgacagagcgagattcggtatccaaaaaaaaaaagttcttgctctgtcactcaggctggagtgaggtggcacgatcacagctcactgcagctttgaccacctgggcttaggcaatcctcctgtctcagcctcccaagtagctgggaccacagatgcatgccaccacacccagctagtcttaacatttttaaattaagcttatatggtttatatttttgatgctgtagtaaactttttatatttttgatgctgtagtaaactttttatatttttaaacaggctatggtagtatttaggaaaactactgatttttatatgtccatcttatatctgtctggtctatctggatatgtatgtattcagattaaataggttctaccagactcttttccataatggttaaaccaattcatgcttctgttaataacgtatgaaagtgatagttgctccacatcctcaccaacacttggttttaccagtcttttaagattttatctattctagtgggacatagtggtttctcattatggttttaatttgcattcttctgatgatgatgaagctgaattcctttttatatgtttattggcatttggatatactcctttgtgaatccctgttaaagttgtcctttgattatcta

SEQ ID NO: 197074 - DNA, 8005 bp, Homo sapiens
  Payload ID: 18868
  Gene Name: ubiquitin protein ligase E3 component n-recognin 3 (putative)
  Uniprot ID: Q6ZT12
  ENST ID: ENST00000272793
  CDS Start-End: 51-5717
tccctggaggagccgctggccctggactctccaaattctgagctctcatcatggcggcggcggccgcggcggccgtcgggggccagcagccgtcacagcccgagctgcccgcgccggggctggccctagacaaggcggccaccgccgcgcacctcaaggcggccctcagccggccggacaaccgcgcaggtgctgaggagctgcaggcgctgctggagcgggtgctgagcgccgagcggccgctggccgcggctgccggcggcgaggacgcggcggcggccggaggcgggggcggtccgggggcggccgaggaggaggccctggagtggtgtaagtgccttctggcgggcggcggcggctacgacgagttctgcgcggcggtgcgggcctacgatcccgcggcgctctgcggcctggtctggacagccaacttcgtggcctaccgctgccggacgtgcggcatctcgccctgcatgtcgctgtgcgccgagtgcttccaccagggcgaccacaccggacacgacttcaacatgttccgcagccaggccgggggcgcctgcgactgcggggacagcaacgtgatgcgggagagcgggttttgcaaaaggcatcaaattaaatcaagttcaaatattccctgtgtccctaaagacttactgatgatgtctgaatttgttcttccaagatttatattttgtcttattcagtacttaagagaaggctataatgaaccagcagctgatggaccatcagaaaaggaccttaacaaagtccttcagcttttggaacctcaaatttcctttttagaagacctgactaaaatgggaggagcaatgcggtctgttcttactcaggttttgacaaaccaacaaaactacaaagatctgacttctggtcttggagaaaatgcttgtgtaaagaaaagtcatgaaaagtaccttatagctttaaagagctctggacttacatatcctgaggataagcttgtatatggtgtgcaggagccatctgctggtactagttctctggctgttcaaggtttcataggcgcaacaggaactttgggacaagtggattcttcagatgaggatgatcaggatggtagtcaaggtctgggcaagagaaaaagggtaaaactaagcagtggcaccaaagatcaatccataatggatgttttgaagcataaaagcttcctagaagaactattattttggactataaaatatgaattccctcaaaagatggtaactttcttactcaacatgcttccagatcaagagtataaggttgcttttacaaaaacttttgttcagcattatgctttcattatgaaaacactgaagaaaagtcatgaatcagacacaatgtctaacagaattgtgcatattagtgttcagttgttcagcaatgaggagctagccagacaggtaacagaagaatgtcagctgctggatattatggtcactgtgctattatacatgatggaaagttgccttattaaaagtgagctacaagatgaagaaaatagtttacatgtggtagtgaactgtggagaagcattactgaagaataacacttactggcctcttgttagtgattttattaatattctttctcatcaaagtgtggccaagagatttttggaggatcacggtttgttagttacatggatgaactttgtatctttctttcaaggtatgaacttaaacaagcgagaactaaacgagcatgtggaatttgagtctcagacctactatgctgcctttgctgctgaacttgaggcctgtgcacagccaatgtgggggcttttatcacattgtaaagttagggaaactcaagagtatacccgaaatgttgttagatattgccttgaagctcttcaagactggtttgatgctattaacttcgtagacgagccagcacctaaccaagtcacttttcatctgccactacatcgttactatgctatgtttttgagtaaggctgtgaaatgtcaagaactagatttggattctgttttaccagatcaggaaatgttaatgaaactaatgattcacccactccaaattcaagcaagtcttgcagaaatccacagcaatatgtgggtaagaaatggtctgcaaatcaaaggacaagccatgacgtatgtccagtctcatttctgtaattccatgattgatcctgacatttacctgttacaggtttgtgcttctagacttgacccagattattttatttcatccgtctttgaaagatttaaggtagtggatttgttgacaatggcatcacaacatcaaaatacagtacttgatgcagagcatgagaggtcgatgttagaaggcgctcttacatttcttgtgattcttttgagtcttcgtttacatttaggaatgtctgatgatgagattctcagggccgagatggtagcccagctgtgtatgaatgacaggacacacagttcattgctggacctcattccagaaaatcctaatcccaaaagtggcattattccaggcagttacagctttgaatcagttttatcagctgtagctgattttaaggctcctgtttttgaacctggaggttctatgcaacaaggcatgtatactcccaaagctgaagtctgggatcaagagtttgaccccgtcatggtcattcttcgaacagtttaccgtagagatgtgcagtctgcaatggacagatatactgcatttttaaaacagagtggaaaatttcctggaaatccctggcctccatataagaaaaggacatcactccatcctagctataaaggtcttatgagacttttgcactgtaaaactttacacattgtgctattcactctgctttacaagattttgatggatcatcaaaatctgtcagaacatgtactctgcatggttttatatctgattgaattaggacttgaaaattctgctgaagaagaatcagatgaagaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaaaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgattctcctgagaatgatattcctatggagatcaccacggcagaaccacaggtttccgaggcagtatatgactgtgttatttgtggacagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccatcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaa

SEQ ID NO: 197075 - DNA, 5129 bp, Homo sapiens
  Payload ID: 18868
  Gene Name: ubiquitin protein ligase E3 component n-recognin 3 (putative)
  ENST ID: ENST00000392632
  CDS Start-End: 1-2852
tgtcagaacatgtactctgcatggttttatatctgattgaattaggacttgaaaattctgctgaagaagaatcagatgaagaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaaaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgattctcctgagaatgatattcctatggagatcaccacggcagaaccacaggtttccgaggcagtatatgactgtgttatttgtggacagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccagtaagcatcagttcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaa

SEQ ID NO: 197076 - DNA, 2183 bp, Homo sapiens
  Payload ID: 18868
  Gene Name: ubiquitin protein ligase E3 component n-recognin 3 (putative)
  ENST ID: ENST00000439681
  CDS Start-End: 1-1767
ttacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccatcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaacttttgcttcattatttttccctttactaaatcagaaattatactgtgccaatatagaaaaagtcatgataaagtttatcctaaatatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatctttttt

SEQ ID NO: 197077 - DNA, 7951 bp, Homo sapiens
  Payload ID: 18868
  Gene Name: ubiquitin protein ligase E3 component n-recognin 3 (putative)
  Uniprot ID: Q6ZT12
  ENST ID: ENST00000418381
  CDS Start-End: 1-5667
atggcggcggcggccgcggcggccgtcgggggccagcagccgtcacagcccgagctgcccgcgccggggctggccctagacaaggcggccaccgccgcgcacctcaaggcggccctcagccggccggacaaccgcgcaggtgctgaggagctgcaggcgctgctggagcgggtgctgagcgccgagcggccgctggccgcggctgccggcggcgaggacgcggcggcggccggaggcgggggcggtccgggggcggccgaggaggaggccctggagtggtgtaagtgccttctggcgggcggcggcggctacgacgagttctgcgcggcggtgcgggcctacgatcccgcggcgctctgcggcctggtctggacagccaacttcgtggcctaccgctgccggacgtgcggcatctcgccctgcatgtcgctgtgcgccgagtgcttccaccagggcgaccacaccggacacgacttcaacatgttccgcagccaggccgggggcgcctgcgactgcggggacagcaacgtgatgcgggagagcgggttttgcaaaaggcatcaaattaaatcaagttcaaatattccctgtgtccctaaagacttactgatgatgtctgaatttgttcttccaagatttatattttgtcttattcagtacttaagagaaggctataatgaaccagcagctgatggaccatcagaaaaggaccttaacaaagtccttcagcttttggaacctcaaatttcctttttagaagacctgactaaaatgggaggagcaatgcggtctgttcttactcaggttttgacaaaccaacaaaactacaaagatctgacttctggtcttggagaaaatgcttgtgtaaagaaaagtcatgaaaagtaccttatagctttaaagagctctggacttacatatcctgaggataagcttgtatatggtgtgcaggagccatctgctggtactagttctctggctgttcaaggtttcataggcgcaacaggaactttgggacaagtggattcttcagatgaggatgatcaggatggtagtcaaggtctgggcaagagaaaaagggtaaaactaagcagtggcaccaaagatcaatccataatggatgttttgaagcataaaagcttcctagaagaactattattttggactataaaatatgaattccctcaaaagatggtaactttcttactcaacatgcttccagatcaagagtataaggttgcttttacaaaaacttttgttcagcattatgctttcattatgaaaacactgaagaaaagtcatgaatcagacacaatgtctaacagaattgtgcatattagtgttcagttgttcagcaatgaggagctagccagacaggtaacagaagaatgtcagctgctggatattatggtcactgtgctattatacatgatggaaagttgccttattaaaagtgagctacaagatgaagaaaatagtttacatgtggtagtgaactgtggagaagcattactgaagaataacacttactggcctcttgttagtgattttattaatattctttctcatcaaagtgtggccaagagatttttggaggatcacggtttgttagttacatggatgaactttgtatctttctttcaaggtatgaacttaaacaagcgagaactaaacgagcatgtggaatttgagtctcagacctactatgctgcctttgctgctgaacttgaggcctgtgcacagccaatgtgggggcttttatcacattgtaaagttagggaaactcaagagtatacccgaaatgttgttagatattgccttgaagctcttcaagactggtttgatgctattaacttcgtagacgagccagcacctaaccaagtcacttttcatctgccactacatcgttactatgctatgtttttgagtaaggctgtgaaatgtcaagaactagatttggattctgttttaccagatcaggaaatgttaatgaaactaatgattcacccactccaaattcaagcaagtcttgcagaaatccacagcaatatgtgggtaagaaatggtctgcaaatcaaaggacaagccatgacgtatgtccagtctcatttctgtaattccatgattgatcctgacatttacctgttacaggtttgtgcttctagacttgacccagattattttatttcatccgtctttgaaagatttaaggtagtggatttgttgacaatggcatcacaacatcaaaatacagtacttgatgcagagcatgagaggtcgatgttagaaggcgctcttacatttcttgtgattcttttgagtcttcgtttacatttaggaatgtctgatgatgagattctcagggccgagatggtagcccagctgtgtatgaatgacaggacacacagttcattgctggacctcattccagaaaatcctaatcccaaaagtggcattattccaggcagttacagctttgaatcagttttatcagctgtagctgattttaaggctcctgtttttgaacctggaggttctatgcaacaaggcatgtatactcccaaagctgaagtctgggatcaagagtttgaccccgtcatggtcattcttcgaacagtttaccgtagagatgtgcagtctgcaatggacagatatactgcatttttaaaacagagtggaaaatttcctggaaatccctggcctccatataagaaaaggacatcactccatcctagctataaaggtcttatgagacttttgcactgtaaaactttacacattgtgctattcactctgctttacaagattttgatggatcatcaaaatctgtcagaacatgtactctgcatggttttatatctgattgaattaggacttgaaaattctgctgaagaagaatcagatgaagaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaaaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgattctcctgagaatgatattcctatggagatcaccacggcagaaccacaggtttccgaggcagtatatgactgtgttatttgtggacagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccatcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtcctt

SEQ ID NO: 197078 - DNA, 3821 bp, Homo sapiens
  Payload ID: 18868
  Gene Name: ubiquitin protein ligase E3 component n-recognin 3 (putative)
  ENST ID: ENST00000444475
  CDS Start-End: 1-234
atgaaagatataaaaaataccactcagaagaaatatagagactatagcaagaccccgggctcaccagacaatgattttctctttatgtactctgttgctagattaggcaacagaagatttgtgaaaacaaaatgtattgatctcatttatattcccttgatgaaggaacacatgctggtctccgctcgctttctgtccactagtatgaaatccttgtccctgcttccttgctgaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagaccactttacctgcattgtgaaggtactttttaccctactgtacacacaggctcttgcagcactctcagttaaatgcagcgaagaagataggtcagcctggaaacacgcgggagctctcaaaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaa

SEQ ID NO: 197079 - DNA, 5411 bp, Homo sapiens
  Payload ID: 18868
  Gene Name: ubiquitin protein ligase E3 component n-recognin 3 (putative)
  ENST ID: ENST00000430321
  CDS Start-End: 1-1153
tcccaaagctgaagtctgggatcaagagtttgaccccgtcatggtcattcttcgaacagtttaccgtagagatgtgcagtctgcaatggacagatatactgcatttttaaaacagagtggaaaatttcctggaaatccctggcctccatataagaaaaggacatcactccatcctagctataaaggtcttatgagacttttgcactgtaaaactttacacattgtgctattcactctgctttacaagattttgatggatcatcaaaatctgtcagaacatgtactctgcatggttttatatctgattgaattaggacttgaaaattctgctgaagaagaatcagatgaagaggcatcagtgggtggaccagaacgttgtcatgacagttggtttcctggcagtaacttagtgtcaaacatgcgacactttataaactatgttagagtaagagttccagagactgctcctgaagtaaagagagactcacctgcaagtactagctctgataacttgggttctttacaaaattctggtacagctcaagttttcagtttagtagcagaacgtagaaagaaatttcaggaaatcatcaatcgcagtagcagtgaagcaaatcaggtggttcgtcccaaaacttcaagtaaatggtctgctcctggttcagctccacagttaactacagccattttggaaattaaagaaagcatattgtctttgctaattaaacttcaccacaaactctcaggaaaacaaaactcctactatcctccttggcttgatgacatagaaattttaatccaaccagaaattcctaaatacagtcatggagatggtataactgccgtggaaagaattttactaaaagctgcatcgcaaagtagaatgaacaaacgcatcattgaagagatatgtagaaaagtgacccctcctgtaccacctaaaaaagtcactgcagcagagaagaaaacattggacaaagaagaaaggcgacagaaggctagagagaggcagcagaaattgcttgcggagtttgcttcacgacagaaaagctttatggaaactgcaatggatgttgtgagacaaaacaaaaacaattttctgaggaatcaattaagcaacgtacccagagcagattgggtggtattgccttgaataagagaatggtcaccttatcctctgaggaaactggagggaaggaggaaagaatggatggagatagagagtggcccctcctctgaagatcgacctactggattagttgtactgttacaagcatcctcagttttggggcagtgccgtgacaatgttgagccaaaaaagttgccgatcagtgaagaggagcagatttacccttgggatacctgtgcagccgttcatgatgtgaggctttcattattacagcgttattttaaggatagttcatgtctcttggcagtatcaattggctgggaaggaggtgtttatgtacaaacctgtggtcacacattacatatagattgtcataaatcttacatggaatcattacggaatgaccaggttcttcagggcttctcggtggacaaaggagaattcacgtgtccactctgtaggcagtttgctaacagtgttcttccatgttatcctggaagcaatgtggaaaataacccttggcaacgtcctagcaacaaaagcatacaagatctcataaaggaagtggaggagctgcagggacgaccgggagctttcccagtaagcatcagttcagaaacaaatttaagtaaagaaatggaatctgtaatgaaagatataaaaaataccactcagaagaaatatagagactatagcaagaccccgggctcaccagacaatgattttctctttatgtactctgttgctagataccatctaacctccaatgaatgataaccatttctctgatagaaaaattgaaccaatttagaacttgaattgattcatcgaggaggcaatttgtgttcaggtggtgcaagcacagctggcaaaaggtcttgtttaactgtttcatgtattagccttgcacatgcggctttatagcattgactctgagtataatccctggagaaagctcacccagttagaagagatgaatccacagctgggatatgaagaacaacagcctgaggttccaattctttatcatgatgtaacatcccttttgctcatccagatcttaatgatgccacaacccttacgcaaagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccagaatttcctatttcatgtctaaaaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcgtatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactatgaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaa

SEQ ID NO: 197080 - DNA, 4031 bp, Homo sapiens
  Payload ID: 18869
  Gene Name: ubiquitin protein ligase E3 component n-recognin 4
  Uniprot ID: Q5T4S7
  ENST ID: ENST00000375218
  CDS Start-End: 1154-1792
cctgtgggaagctcagtcagcattctgaggagttatttgcatggtgataggctcttacataggaattgacaagcgcctgagagaagagcgaatctgcctagttgagattccaatcccctccatgtaggccagggtcttgcaaatagaaggtactcaaaatgtcattgctgagttcagggtttggtgagtagtaatgtagaaaggtctgtatagcctgggcaacatagtgagacttcatctcttaaaaaaaaatttaaaaaagttagccaggcgtggtggcgtgtacctgtggtcccagctgctggggaggctgaggcaggaggatggcttggggccagaagttcgagggtgcaatgaactgtgatccacgccactgcactccagcctgggtgacagagtgagaccctgtctcaaaaaaaaaaaaaaaaaaaggtctttagtttcaagggtttaagttaaataaggtgaaacaaatttaaagaaaatgtcttcctttttttaaaaaaacttctaaaagaggatattggttaaattgacagtttattatttctctggtttagtagtgactgttctttaaaaaaaatttaaaaaaactttattgagataatttatgtattaacctattttaaatgtacagttcaatgatttttagtaaatttaattgtgactcttgagtcaaattttactactttttagaattcctctgaaggatagatcaaagattaggaaacatctaaggtcagttagttgaaatttctttcctgtggcttcgtaaccctattgggatttctcctgtgtccttgagttctcactagggtggggctcactttgggctcactttggctcacattgagccatggctttgtcatgatttttttgtgaaactcagtgcttcctaagatgaaaatgtgttcatgctaagactggtttcttccttagcactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccaggtagagagcggggagcagcttttgggtgtgttttgtccaagtgttactggtgttgttttcacagcagtcctgctgctctctcatctagcagtccaggtcttggtgttgtccctgcccaatctagctgaaaaggcaggcagatggctgcaccaaacggcatctcccccaccgtgatttatggcgctggtcagaatgctgagttcatgctagataactgaacatactggtgatgggaaggtaacacagataagggttttttttagccattaacaacccatctcttagtagaggggttactggtcttaaaaaatttgatgccaagattctgttccctcttctgataacgccgtgtttgcaggctgtagggtaagggcataccaactgcaatcaaccagggtgggccttgtgtcagttgcaatgtcacagacctaatctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcggtcagtacctacaccatggttatgggcctagtggttcctactgacactggcagccatgccaggagcgttagagagtgcacagaatagtgcttctgaccacccagcaagttaggtagcttataacaaaggaaagatggaaagagacacagggtgtaggtgagcgagcttggggagcattgaaacccaggtttccttgtaaatggcatgattggcttgtgcttttttggttccagtacagtgtcttgaggaaactctccctgaggccttgtgagggaagggaagggagacacttgaactcgagaaagactcacatgaaagaagcagagcagtggggcctggagattaagagcttggactctggattggaaaggctcagtttcagtatctgataccttgtactatacgccttggacagattccttaatttctctgagtctgtgttttcctcatctgaaaaatactgacagtaggctgggcacagtggctcttgcccgtaatcccagcactttggcacctgaggctggcagatcacttgaggtcaggagttcaagaccagcctggccaacatggtaaaacctcgtctccattaaaaatacaaaaatagggccaggtgctgtggctcatgcctgtaatcccagcactttggcaggccaaggcgggtggatcacctgaggtcgggagttcaagaccagcctgaccaacatggagaaaccccatctccactgaaaatacaaaattagacaggtgtagtggtgcatgcctgtaatctcagctacttgggaggctgagacaggagaatcgcttgaacctgggaggcggagattgtggtgagtcgaaatcgtgccattgcactccagcctgggcaacaagcgagactccgtctc

SEQ ID NO: 197081 - DNA, 3475 bp, Homo sapiens
  Payload ID: 18869
  Gene Name: ubiquitin protein ligase E3 component n-recognin 4
  ENST ID: ENST00000375224
  CDS Start-End: 485-3157
ttttatgacttcattgtatttattatgtagctgtagcaaactcttgggagcatttggactgtttacagtttttaagcaatcccttaccagcgctgtgactgttggcttcctggaaaggagttctgcaagggttcgattaagaagatgtaactacagagtgtctggtgctgcaagctcctgggacagtggtggaggtaactggtatccttggcagtgatatcacactgactgcacttgtcatcctgtttaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattg

SEQ ID NO: 197082 - DNA, 1533 bp, Homo sapiens
  Payload ID: 18869
  Gene Name: ubiquitin protein ligase E3 component n-recognin 4
  ENST ID: ENST00000375225
  CDS Start-End: 435-1211
cactgagtctggtgtggtcatcatcatcatcatcattgcaacttaggacgcatgaggacaagaagcagcgctcatctggaagaggctgttctaacgaaggcgggaggatcctagatcagaagaagacaaaccggaagagggagcctaggaaaggaaccacatgcacatttagtgcaaaccatgtaaacataacataacaagactatgtggagcaagggggagtcaggctgtggacccaccagggaatcttgattcatgtttttggccccatcactcactagcttgctgactttgggcaagtcacttcacttttctgggcctctggagttactagcacagttccatgttggggagattgtgaacgtccctgatatatggtgctcaggaaccagtagttgcttggaattgtattagagctggggtaggagctagacatggggccagggaagaagggaagatgccgcgaagaagggcctggaaggggacgaagggcgtggattatcagaggaagtgggagtagtcggcaaggatgggtggggagtgttgagtcatccaagcgttcagcaaatgtcacaagacaacgacaaattgagcaaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 197083 - DNA, 15906 bp, Homo sapiens
  Payload ID: 18869
  Gene Name: ubiquitin protein ligase E3 component n-recognin 4
  Uniprot ID: Q5T4S7
  ENST ID: ENST00000375254
  CDS Start-End: 29-15580
ggagggagccgcagtagtacgacggaagatggcgacgagcggcggcgaagaggcggcggcagcggctccggcgccggggaccccggcaacgggggcggacacgaccccgggctgggaggtggctgtgcggcccctgctgtccgcgtcctactccgccttcgagatgaaggagttgccgcagctggtggcctcagtcatcgagagtgaatcagaaatcctgcaccatgagaagcagtacgagccattctactcatcttttgttgcactttccacacactatattacaacagtttgcagtctcattccccggaaccaacttcagtcagtggcagcagcctgtaaagttctaattgagttttctctcctgcgtctggagaatccagatgaggcttgtgctgtgtcccagaaacacttgattctcctaatcaagggcctgtgcactggctgtagccgactagatagaactgaaattatcacatttacagcaatgatgaaatccgccaagctgccccaaacagtgaagacactttcagacgtggaagatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatggctttcattcattggtgattgatgtaactatggcattggataccctttctctacctgtgttggaacctctcaatccttctcgtctacaagatgtgacagtcctcagcctaagttgtctgtatgcaggtgtgagtgtggcaacgtgcatggccatcctccatgtgggtagtgcccagcaagtgcggacagggtccacgagctccaaagaagatgactatgaaagtgacgcagctacaattgtccagaaatgtctcgaaatctatgacatgattggacaagcaatcagcagttctcgccgggctggtggtgagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggcatcagggatttggggtactctcagtaatattggcaaaccatgccatcaaactgctaacgtctctctttcaagacctacaagtggaggcccttcacaagggttgggagacagatggcccccctgcagccttgagcattatggcccagagcacctccatacagaggattcaacggctgattgactctgtcccactgatgaacctgctcttgacgttactttcaacttcctacagaaaggcatgtgtcctgcagcggcagaggaagggctccatgagcagcgatgccagcgcctccaccgactccaatacttactatgaggacgatttcagtagcacggaggaggacagcagccaagacgatgacagtgagcctattttggggcaatggtttgaggagactatttctcccagtaaagagaaagcagcacctccgcctcctcccccacctcctccactggaaagctctcctcgggttaaaagccccagtaagcaggcccctggtgagaagggcaacattctggcgagtcgcaaagatcctgagttgttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggttcatcagatgaagagtttgctgcagctctctatcacttcaaccactcactggtaacctctgaccttcagtcacctaacctgcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagcataacctgctaagtcctccctttgggtgggcaagtggatcccaggacagcaacagccgccgggcaaccactcctctctatcatggattcaaagaagtagaagaaaactggtctaagcatttctcatcagatgctgtcccacaccccagattctactgtgtcctgtccccagaagcctcagaggatgatttgaaccgacttgattctgtggcatgtgacgtccttttctccaagcttgtcaagtatgatgagctttatgctgcactgacagccctgcttgcagctgggtcccagcttgatacagttaggagaaaggaaaacaagaatgtaacagccttggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggatcaccttatcaaacagggaatgaaggctgagcatgctagctcgcttctagaactggcatccaccactaagtgtagctcagtgaaatatgatgttgaaatagtagaggaatacttcgctcgacagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaa

SEQ ID NO: 197084 - DNA, 2954 bp, Homo sapiens
  Payload ID: 18869
  Gene Name: ubiquitin protein ligase E3 component n-recognin 4
  ENST ID: ENST00000425413
  CDS Start-End: 1-2954
gacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaa

SEQ ID NO: 197085 - DNA, 6175 bp, Homo sapiens
  Payload ID: 18869
  Gene Name: ubiquitin protein ligase E3 component n-recognin 4
  ENST ID: ENST00000417040
  CDS Start-End: 1-6175
ctggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagagttctgaaactgagtccctaaccaagctggaccggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaag

SEQ ID NO: 197086 - DNA, 9418 bp, Homo sapiens
  Payload ID: 18870
  Gene Name: ubiquitin protein ligase E3 component n-recognin 5
  Uniprot ID: O95071
  ENST ID: ENST00000220959
  CDS Start-End: 456-8852
tggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagc

SEQ ID NO: 197087 - DNA, 9008 bp, Homo sapiens
  Payload ID: 18870
  Gene Name: ubiquitin protein ligase E3 component n-recognin 5
  ENST ID: ENST00000521922
  CDS Start-End: 526-8904
cccgtttgcccctcccccgccgctccggagcggagcctgcgagacggagaaactggggcagaagtgaagatggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccc

SEQ ID NO: 197088 - DNA, 563 bp, Homo sapiens
  Payload ID: 18870
  Gene Name: ubiquitin protein ligase E3 component n-recognin 5
  ENST ID: ENST00000521566
  CDS Start-End: 64-563
acacttatctgtgctccttttccaagtttgtaattctcttacaagaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagag

SEQ ID NO: 197089 - DNA, 602 bp, Homo sapiens
  Payload ID: 18870
  Gene Name: ubiquitin protein ligase E3 component n-recognin 5
  ENST ID: ENST00000519365
  CDS Start-End: 1-602
tgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctac

SEQ ID NO: 197090 - DNA, 1931 bp, Homo sapiens
  Payload ID: 18870
  Gene Name: ubiquitin protein ligase E3 component n-recognin 5
  ENST ID: ENST00000518205
  CDS Start-End: 244-1827
tttgtaatggataagcttctgagaactccaattactttgttgttttttaaactctcaaggaaaggctaaaactagattttcagattgtacatagaaaaattcaagctactttccaacattgaatttactactttttgacttcttgatgtgttttaataggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccc

SEQ ID NO: 197091 - DNA, 10297 bp, Homo sapiens
  Payload ID: 18870
  Gene Name: ubiquitin protein ligase E3 component n-recognin 5
  Uniprot ID: O95071
  ENST ID: ENST00000520539
  CDS Start-End: 608-9007
gagggggccttgccgcccgtttcccggagccccgcctctcgccgccgcgcccccgcccgccggtctcctccctcctcctcctcccgtttgcccctcccccgccgctccggagcggagcctgcgagacggagaaactggggcagaagtgaagatggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcc

SEQ ID NO: 197092 - DNA, 582 bp, Homo sapiens
  Payload ID: 18870
  Gene Name: ubiquitin protein ligase E3 component n-recognin 5
  ENST ID: ENST00000520898
  CDS Start-End: 1-582
attcatcagccacagatgtgatggaaatcgaaatattttgcatgcttgtgtatcagtttgctttccaaccagcaataaagaaactaaagaagaagaggcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaact

SEQ ID NO: 197093 - DNA, 3694 bp, Homo sapiens
  Payload ID: 18871
  Gene Name: ubiquitin protein ligase E3 component n-recognin 7 (putative)
  Uniprot ID: Q8N806
  ENST ID: ENST00000013070
  CDS Start-End: 237-1514
agaacacgacaccgggaagcgccacccggaggcggaaatcagcccgcgtccggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttctccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 197094 - DNA, 1413 bp, Homo sapiens
  Payload ID: 18871
  Gene Name: ubiquitin protein ligase E3 component n-recognin 7 (putative)
  ENST ID: ENST00000416753
  CDS Start-End: 331-1413
agaacacgacaccgggaagcgccacccggaggcggaaatcagcccgcgtccggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagaaaaaagagaagaagagtggatgggatgcagtattactgcagctagagtggagtatgaagctttctcattcaagccaatga

SEQ ID NO: 197095 - DNA, 1276 bp, Homo sapiens
  Payload ID: 18871
  Gene Name: ubiquitin protein ligase E3 component n-recognin 7 (putative)
  ENST ID: ENST00000553674
  CDS Start-End: 50-214
ttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttgg

SEQ ID NO: 197096 - DNA, 587 bp, Homo sapiens
  Payload ID: 18871
  Gene Name: ubiquitin protein ligase E3 component n-recognin 7 (putative)
  ENST ID: ENST00000554232
  CDS Start-End: 52-587
gcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggatt

SEQ ID NO: 197097 - DNA, 507 bp, Homo sapiens
  Payload ID: 18871
  Gene Name: ubiquitin protein ligase E3 component n-recognin 7 (putative)
  ENST ID: ENST00000556871
  CDS Start-End: 50-507
ttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccggga

SEQ ID NO: 197098 - DNA, 490 bp, Homo sapiens
  Payload ID: 18871
  Gene Name: ubiquitin protein ligase E3 component n-recognin 7 (putative)
  ENST ID: ENST00000555113
  CDS Start-End: 1-490
ggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgag

SEQ ID NO: 197099 - DNA, 522 bp, Homo sapiens
  Payload ID: 18871
  Gene Name: ubiquitin protein ligase E3 component n-recognin 7 (putative)
  ENST ID: ENST00000553857
  CDS Start-End: 1-522
gtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagaatacaatgatttgaagactgaacttaaagactatctcaagagatttgctgatgaaggcacggttgttaagagagaggacattcagcagttctttgaagagtttcagtcaaaaaagagaagaagagtggatgggatgcagtatt

SEQ ID NO: 197100 - DNA, 563 bp, Homo sapiens
  Payload ID: 18871
  Gene Name: ubiquitin protein ligase E3 component n-recognin 7 (putative)
  ENST ID: ENST00000555329
  CDS Start-End: 1-373
agtagagcagaacagtgaaccatgtgccggctctagttctgaatctgatctccagaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtg

SEQ ID NO: 197101 - DNA, 1413 bp, Homo sapiens; identical to SEQ ID NO: 197094
  Payload ID: 18871
  Gene Name: ubiquitin protein ligase E3 component n-recognin 7 (putative)
  ENST ID: ENST00000611035
  CDS Start-End: 331-1413

SEQ ID NO: 197102 - DNA, 3694 bp, Homo sapiens; identical to SEQ ID NO: 197093
  Payload ID: 18871
  Gene Name: ubiquitin protein ligase E3 component n-recognin 7 (putative)
  Uniprot ID: Q8N806
  ENST ID: ENST00000619583
  CDS Start-End: 237-1514

SEQ ID NO: 197103 - DNA, 490 bp, Homo sapiens; identical to SEQ ID NO: 197098
  Payload ID: 18871
  Gene Name: ubiquitin protein ligase E3 component n-recognin 7 (putative)
  ENST ID: ENST00000625851
  CDS Start-End: 1-490

SEQ ID NO: 197104 - DNA, 522 bp, Homo sapiens; identical to SEQ ID NO: 197099
  Payload ID: 18871
  Gene Name: ubiquitin protein ligase E3 component n-recognin 7 (putative)
  ENST ID: ENST00000627299
  CDS Start-End: 1-522

SEQ ID NO: 197105 - DNA, 563 bp, Homo sapiens; identical to SEQ ID NO: 197100
  Payload ID: 18871
  Gene Name: ubiquitin protein ligase E3 component n-recognin 7 (putative)
  ENST ID: ENST00000625902
  CDS Start-End: 1-373

SEQ ID NO: 197106 - DNA, 507 bp, Homo sapiens; identical to SEQ ID NO: 197097
  Payload ID: 18871
  Gene Name: ubiquitin protein ligase E3 component n-recognin 7 (putative)
  ENST ID: ENST00000630635
  CDS Start-End: 50-507

SEQ ID NO: 197107 - DNA, 587 bp, Homo sapiens; identical to SEQ ID NO: 197096
  Payload ID: 18871
  Gene Name: ubiquitin protein ligase E3 component n-recognin 7 (putative)
  ENST ID: ENST00000628088
  CDS Start-End: 52-587

SEQ ID NO: 197108 - DNA, 5051 bp, Homo sapiens
  Payload ID: 18872
  Gene Name: ubiquitin protein ligase E3A
  Uniprot ID: Q05086
  ENST ID: ENST00000232165
  CDS Start-End: 609-3167
gctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtg

SEQ ID NO: 197109 - DNA, 2873 bp, Homo sapiens
  Payload ID: 18872
  Gene Name: ubiquitin protein ligase E3A
  Uniprot ID: Q05086
  ENST ID: ENST00000397954
  CDS Start-End: 246-2873
agcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaa

SEQ ID NO: 197110 - DNA, 2986 bp, Homo sapiens
  Payload ID: 18872
  Gene Name: ubiquitin protein ligase E3A
  Uniprot ID: Q05086
  ENST ID: ENST00000428984
  CDS Start-End: 397-2955
gcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaactcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaa

SEQ ID NO: 197111 - DNA, 2658 bp, Homo sapiens
  Payload ID: 18872
  Gene Name: ubiquitin protein ligase E3A
  Uniprot ID: Q05086
  ENST ID: ENST00000438097
  CDS Start-End: 100-2658
ggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaa

SEQ ID NO: 197112 - DNA, 3176 bp, Homo sapiens
  Payload ID: 18872
  Gene Name: ubiquitin protein ligase E3A
  Uniprot ID: Q05086
  ENST ID: ENST00000566215
  CDS Start-End: 587-3145
cgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaagtgagccaccatttgaatttgctagctcatgctgcagtattcagattatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaa

SEQ ID NO: 197113 - DNA, 571 bp, Homo sapiens
  Payload ID: 18872
  Gene Name: ubiquitin protein ligase E3A
  ENST ID: ENST00000604860
  CDS Start-End: 1-570
cattttcccatggttgtctacaggaagctaatggggaaaaaaggaacttttcgtgacttgggagactctcacccagaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaa

SEQ ID NO: 197114 - DNA, 8741 bp, Homo sapiens
  Payload ID: 18872
  Gene Name: ubiquitin protein ligase E3A
  Uniprot ID: Q05086
  ENST ID: ENST00000614096
  CDS Start-End: 714-3332
ggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 197115 - DNA, 424 bp, Homo sapiens
  Payload ID: 18872
  Gene Name: ubiquitin protein ligase E3A
  ENST ID: ENST00000628890
  CDS Start-End: 306-424
gaattattacattttctcaaatgaagagatcatttaagaaaaacaaaatgctggaaaatagtccttaaaaacttttctataataattactcttctgatgaattttacattgacacctaatttgaagctttgaatattattttttgaacaatgaattgggtttatatattaaagtgttctaaccaaaggtttgtttaatttattagagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgaggg

SEQ ID NO: 197116 - DNA, 889 bp, Homo sapiens
  Payload ID: 18872
  Gene Name: ubiquitin protein ligase E3A
  ENST ID: ENST00000630907
  CDS Start-End: 445-889
agaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtg

SEQ ID NO: 197117 - DNA, 394 bp, Homo sapiens
  Payload ID: 18872
  Gene Name: ubiquitin protein ligase E3A
  ENST ID: ENST00000626589
  CDS Start-End: 371-394
cacagtgactgcaccattttacattcccaccagcagtgaataagggttccaatttctctgcatcttttctaacacttgaggggaggtatggtgtcaagaaaacatagtcaccattattacgaaaagtaaaatatggaagagatgatccctaccatcaatcagcttacaactagaggcactgacaaatgtatacagatagctgtaatgttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatca

SEQ ID NO: 197118 - DNA, 5075 bp, Homo sapiens
  Payload ID: 18872
  Gene Name: ubiquitin protein ligase E3A
  Uniprot ID: Q05086
  ENST ID: ENST00000630424
  CDS Start-End: 627-3185
cggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaa

SEQ ID NO: 197119 - DNA, 706 bp, Homo sapiens
  Payload ID: 18872
  Gene Name: ubiquitin protein ligase E3A
  ENST ID: ENST00000628733
  CDS Start-End: 146-706
aggcggccgccgcagcccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaa

SEQ ID NO: 197120 - DNA, 654 bp, Homo sapiens
  Payload ID: 18872
  Gene Name: ubiquitin protein ligase E3A
  ENST ID: ENST00000625681
  CDS Start-End: 612-654
gcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacg

SEQ ID NO: 197121 - DNA, 1112 bp, Homo sapiens
  Payload ID: 18872
  Gene Name: ubiquitin protein ligase E3A
  ENST ID: ENST00000629252
  CDS Start-End: 966-1112
gctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagagagttacagtggaggtaaaaggagtggcttgcaggatggagaagctgcaccagtgttattggaatgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagcc

SEQ ID NO: 197122 - DNA, 436 bp, Homo sapiens
  Payload ID: 18872
  Gene Name: ubiquitin protein ligase E3A
  ENST ID: ENST00000629886
  CDS Start-End: 204-436
agtaggcccctggtggccgcggctgctgcagccgtaactgttaaaaatctgtaagagcctgattttagaattcaccagctcctcagaagtttggcgaaatatgagttattaagcctacgctcagatcaaggtagcagctagactggtgtgacaacctgtttttaatcagtgactcaaagctgtgatcaccctgatgtcaccgaatggccacagcttgtaaaagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaa

SEQ ID NO: 197123 - DNA, 445 bp, Homo sapiens
  Payload ID: 18872
  Gene Name: ubiquitin protein ligase E3A
  ENST ID: ENST00000626176
  CDS Start-End: 1-430
gatatcacagacagatctttttggtaacccaatgatgtatgatctaaaggaaaatggtgataaaattccaattacaaatgaaaacaggaagaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaa

SEQ ID NO: 197124 - DNA, 3217 bp, Homo sapiens
  Payload ID: 18872
  Gene Name: ubiquitin protein ligase E3A
  ENST ID: ENST00000625778
  CDS Start-End: 604-2901
ctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattaggtgaggtacttagttcttcagaggaagatttgattcaccaaaggggtgtgtgattttgcttcagacctttatctctaggtactaattcccaaataagcaaactcacaaattgtcatctatatacttagatttgtatttgtaatataatcaccatttttcagagctaatcttgtgatttatttcatgaatgaagtgttgttatatataagtctcatgtaatctcctgcatttggcgtatggattatctagtattcctcactggttagagtatgcttactgctggttagaagataattaaaataaggctaccatgtctgcaa

SEQ ID NO: 197125 - DNA, 772 bp, Homo sapiens
  Payload ID: 18872
  Gene Name: ubiquitin protein ligase E3A
  ENST ID: ENST00000626068
  CDS Start-End: 61-772
cttaaatcttgtttacaaaattgtcttcctaagtaatatgtctacctttttttttggaatatggaatattttgctaactgtttctcaattgcattttacagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctg

SEQ ID NO: 197126 - DNA, 1873 bp, Homo sapiens
  Payload ID: 18872
  Gene Name: ubiquitin protein ligase E3A
  ENST ID: ENST00000630607
  CDS Start-End: 1688-1873
aataaaactagtatacttttctctcctagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggactttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccagatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcct

SEQ ID NO: 197127 - DNA, 779 bp, Homo sapiens
  Payload ID: 18872
  Gene Name: ubiquitin protein ligase E3A
  ENST ID: ENST00000628267
  CDS Start-End: 631-779
tcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggttaaaaatctgtaagagcctgattttagaattcaccagctcctcagaagtttggcgaaatatgatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccct

SEQ ID NO: 197128 - DNA, 5722 bp, Homo sapiens
  Payload ID: 18873
  Gene Name: ubiquitin protein ligase E3B
  Uniprot ID: Q7Z3V4
  ENST ID: ENST00000342494
  CDS Start-End: 596-3802
cggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagtcttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaagagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacaaggaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagcata

SEQ ID NO: 197129 - DNA, 1448 bp, Homo sapiens
  Payload ID: 18873
  Gene Name: ubiquitin protein ligase E3B
  Uniprot ID: Q7Z3V4
  ENST ID: ENST00000340074
  CDS Start-End: 586-1320
tggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataa

SEQ ID NO: 197130 - DNA, 5620 bp, Homo sapiens
  Payload ID: 18873
  Gene Name: ubiquitin protein ligase E3B
  Uniprot ID: Q7Z3V4
  ENST ID: ENST00000434735
  CDS Start-End: 491-3697
aacgtcttaagccgtccgttgtgcgcctaggggccagttttctttccagcctccccggccggagtgggttccagcttttctcggctggggagggcatttatcccacctccgctatttcagctgccagaggggaggcaaggtgtggggaagttttccttcccgggcgaagaagctctgcggaactgtcattttccggaactggatgcttgcttcctggcggggttctgaaagcgaacaccgcggggcaagatggcggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagtcttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaagagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacaaggaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagcatatga

SEQ ID NO: 197131 - DNA, 3771 bp, Homo sapiens
  Payload ID: 18873
  Gene Name: ubiquitin protein ligase E3B
  Uniprot ID: Q7Z3V4
  ENST ID: ENST00000449510
  CDS Start-End: 585-2711
ggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggagagcttgtttgagtgcccctggccactggtgatcaatgccgagagctgctaggaaggcagtgtgtgctgaacagtggatgtttctgacattcttcaaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataagtgagtatagcaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccag

SEQ ID NO: 197132 - DNA, 3600 bp, Homo sapiens
  Payload ID: 18873
  Gene Name: ubiquitin protein ligase E3B
  ENST ID: ENST00000537063
  CDS Start-End: 238-981
cggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcaggtctgtgactcctgccccccagtgtgcaacttctccactctccaacacctgcacttggatttttacatttgcattcagcatacctggtgtcctcctcagaaacacttttcataggaagagcttgatgcctgctgtcctcttcttccttcccctgccttgtctcacttgtgggtcaggtaaagggaggacagtggtgctgggatcccttgaatgctctacatttttggctgcaagggtaatccagtcttttgacatttaaactctggaaggagacctcagggcttgttccctcagattccttcttggttgatgtctagaatcatatttctagctctgtgtcctcaaacagccctttccactttgtaccttgttgtgccagatcatacctctagggaattgttgagaaagcctgattgctgtttaaaggtacaatggaagtcttgagtttgagaagtaatgttgactttgcccttccttctccctagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacggtgagtaagaaaccatagctgaggtgttggcatgttcttgaatgcttcctcctcttggtttttctttctctcgttactggtattaggtatagacttgcccattttgtcagaatttatgggaagcattgttcttaatgaaagtgagcacatttgtgactgctcaaactttttcttaatcttcagtcttgaatatttcttaatcttcagccctgaatattattgcagtgtgatctttggaaactattcaaaatgaatttcttttatctaaaagaggccaagatgcaatcatttttccttttgaagttttaattgacaaaacaaaaaacctaggagccaggagaagcccagcaaagggcagggtgagaggattaaggaaataatgtgaatacgcatgtaaaatgttagaatttggaggaccagagaagaggtgatatttgccttcacttagtttggagatgtcaggtactgaagaagctaagttaattccttatggaaattacacctgcaattctgagaattgccaaatgtaaaacactatgcttgttcataggtccagaacatgtttaaactgtcaaggggaacactagcttggggagatgttaataaaagatcctggaaggaagagtgtcatggtggaaccagcttggtgaaagctgcctgctctgcccccatctgtggatctacagtacaccttcatgctgagagctctgagaagtgctgctatgctagcaggaccccatgggcttatttaacccggggttggcccaaacgtatctgagcatggaatacccctgccttgttttttggatgccgttgatatcccatgaaatcattttccatggaaaacctatttggaaaatgatgggctagagcatgggttggccaaattttctggaaagagccggataaatatttcaactctatgggccatacagcctctgtcacaaccactctgccattgcatcttgaaagcagtcgtagattgtacatacacaaatgagcatgactgtgttccagtaaaactttatttacaaaaataggccatagtttataaacacctggtctagactgtgctttccactaaccactagccacagggggctgtttaaatgaaaattcatttaagttaaataaaatgaagaattcacttcctcagttgcattagccacatttcaaatgctcagcggccacatgtaactagtagcaattgtgtgggacagcacagatatagaaaacttccagcatcacagaaagttctgttggacaaggctgacctagagcaggtctgtccgatggaaacacagttagagccacatttaaaaagccaaaagaggccaggcacggcggcccatgcctgtaatcccagcactttgggagactgaggtgggcagatcattttgagctcaggagttcaagaccagtctgggcaacatggccaaaccttgtctctacaaaaaatacaaacattagctgggcatggtgccatgtgcctgtggttccagctactcaggagtctgaggtgggaggatcactggagccagggaagtcaaggctgcagcgagccgtgattgagcttctccagcctggatgacagagtgatacctggtctc

SEQ ID NO: 197133 - DNA, 1120 bp, Homo sapiens
  Payload ID: 18873
  Gene Name: ubiquitin protein ligase E3B
  Uniprot ID: Q7Z3V4
  ENST ID: ENST00000536398
  CDS Start-End: 258-992
aacaccgcggggcaagatggcggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataa

SEQ ID NO: 197134 - DNA, 2763 bp, Homo sapiens
  Payload ID: 18873
  Gene Name: ubiquitin protein ligase E3B
  ENST ID: ENST00000539599
  CDS Start-End: 149-2763
accgcggggcaagatggcggtagtgcgtcggctgctgccccgggtctggcagaactcgggtgttttgggctgagacagtggcagctgcggccccgaccccaagtgcggggacctccggcgaataaagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttac

SEQ ID NO: 197135 - DNA, 1541 bp, Homo sapiens
  Payload ID: 18873
  Gene Name: ubiquitin protein ligase E3B
  Uniprot ID: Q7Z3V4
  ENST ID: ENST00000540230
  CDS Start-End: 252-986
ggcggtagtgcgtcggctgctgccccgggtctggcagaactcgggtgttttgggctgagacagtggcagctgcggccccgaccccaagtgcggggacctccggcgaataaaggtcggcctgcggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacggtgagtaagaaaccatagctga

SEQ ID NO: 197136 - DNA, 1230 bp, Homo sapiens
  Payload ID: 18873
  Gene Name: ubiquitin protein ligase E3B
  ENST ID: ENST00000605142
  CDS Start-End: 1-528
actcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcagcaaggcaggcagctggacccctcagagccaagtgaggagggccccacagttctcacggcaggagaaccagccagccccagagagactgcccacggactcagccctctctcggcagcccctttctctttccttcctcagggaagggtacctggagtgggggtgggtacgtgctgtttttagtggcgtctggcctcaccagggctccagatctgaggcagcatgggagaaagtgagagagtgggctcaggaggcaggcaggcgcagactcgaatgctactcctaccccagcaggctgtgcacgtccaggctcgctgcttcatttcctcattggccaaaggagaaggaaagccttcagggttacggagctctgtgtgtctcaagcctggcccactgtgggtgctcaaatgagagtcctactccccataaaaacccagtggccgcctctgggtgtagctgcctctcatgatgcagtttgagcccgtgatgccaccttgtacaggaagctacacagtcctcggcctccatgcttaagggaaagttggcccaagtcatggtctgccaccggccacagcaccggtgaggagggaggagtgcattcagaaatgtttgggcacctaacagtttttacagcattctactttttgtcaattggttaaccagtaattcgctgtgaaccggaaggccccatttccaaaagcttacttagtgcaggaattctctgtgcaggccccagggagaaggggttccttctctggaagccagtcgtcttgtgtctggggcttgacctcgggtagtggtgccagggcagcgccctgcactctgcccagcatccagggactggccagatcccctccctgggctccctggccttggcatcagcct

SEQ ID NO: 197137 - DNA, 5229 bp, Homo sapiens
  Payload ID: 18874
  Gene Name: ubiquitin protein ligase E3C
  Uniprot ID: Q15386
  ENST ID: ENST00000348165
  CDS Start-End: 361-3612
tctgcagggccgcgcacgcactgacggctgaccgccatcttccctcccgaggcggcagttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttatctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagtgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctcgtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaaga

SEQ ID NO: 197138 - DNA, 1626 bp, Homo sapiens
  Payload ID: 18874
  Gene Name: ubiquitin protein ligase E3C
  Uniprot ID: Q15386
  ENST ID: ENST00000389103
  CDS Start-End: 79-1293
cctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaagtattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcagggtgtacaaatgaatgtggagacctttgtaccctgacatggaaagatttccgagacagatgcgtacatgaaaaccgggaagacacaggacagtatgtagaagaaccggcttttcctataagaaggatggaaaaaataggaatatatattcatattgcataaagaaacttggaagcatatacaagaaactcatgaaagtgaacactcgtgtctgaatatgccgaggaagctggggctggagcagaagtgctcttctgagtacactatttttatatcacttttaagttttggattaggtgaatgacttaatattttaaaattggttaagtaataaatgaattgccagc

SEQ ID NO: 197139 - DNA, 448 bp, Homo sapiens
  Payload ID: 18874
  Gene Name: ubiquitin protein ligase E3C
  ENST ID: ENST00000430750
  CDS Start-End: 1-171
agcttcgaaggcgacttcaagacgcggcccaaggtgtcccttggcggcgcgagcaggaaggaggaaaaggcttctcttttacatcgtactcaggaagaaagaagaaagagagagtgttgggattacaggcgtgaactgcctcgtctggctgatgatgttgatgtttcatgaagcataaggagaaagctcactgttaagacatgtgtcttaactgtttgtgaagaaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttg

SEQ ID NO: 197140 - DNA, 1866 bp, Homo sapiens
  Payload ID: 18874
  Gene Name: ubiquitin protein ligase E3C
  Uniprot ID: Q15386
  ENST ID: ENST00000611269
  CDS Start-End: 317-1531
gcagggccgcgcacgcactgacggctgaccgccatcttccctcccgaggcggcagttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaagtattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcagggtgtacaaatgaatgtggagacctttgtaccctgacatggaaagatttccgagacagatgcgtacatgaaaaccgggaagacacaggacagtatgtagaagaaccggcttttcctataagaaggatggaaaaaataggaatatatattcatattgcataaagaaacttggaagcatatacaagaaactcatgaaagtgaacactcgtgtctgaatatgccgaggaagctggggctggagcagaagtgctcttctgagtacactatttttatatcacttttaagttttggattaggtgaatgacttaatattttaaaattggttaagtaataaatgaattgccagctc

SEQ ID NO: 197141 - DNA, 1879 bp, Homo sapiens
  Payload ID: 18875
  Gene Name: ubiquitin protein ligase E3D
  ENST ID: ENST00000237186
  CDS Start-End: 124-234
acaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggagagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagca

SEQ ID NO: 197142 - DNA, 2740 bp, Homo sapiens
  Payload ID: 18875
  Gene Name: ubiquitin protein ligase E3D
  ENST ID: ENST00000369746
  CDS Start-End: 1-551
tccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagccaggtcatgctgatgcaagaggtgggctcccatggccttgaacagctctgttcctgtggttttgccggaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaagtaagttgtgcatttgttttctctttccacattatgttttagcttttgttgtcatgttggtgttaagaaattaatgaattaaatgccactataccatttccctacttgaagcttctaggagccaatactgctaaatattatatgtttaaaataggttgaattattacagatgattcatgttaatatgcagaaagcttgcttttaccaaaaattattgtttttttcttgtaatctaagctgtctgtacatatggctgcagtgctaaatcagacttcaacagtgatgaatatttaccaataagcactttccaggcatcaggatacaataatgaacaaaccccagcccctacctcttagcattgttgttctaatagggggaaggcagaccataaacaaaacagattcttacgtctcttactatgtgtcaggcactcatctaagaactcgtagctcatttaagcctaacaacaacctgtgtggtatgtaccattatcatccccactttaaagataagcacactaagacactggtagtaaatcactctagtgaaaaatgaagcaaggtaaggtagttggcgaggggtaggatgggagtaggatgtcattttatattgcaaagtcagggaagattctttagataaggtgatatttaagcaggtaacttgaaggaagtgaagtggtgagccatatctgatggaagatcattcccagaaaaggaaacagcaggttattttaattgtaacagaatcaaagtttgtacttgtcctgtactcttagatgggtttgatcaaatttatcctaagaacggaagggtcttagtctttttctggaaagtaaataagacattgaaaaaattaattaggtttcttatgcaagtagtaccagtcataaaatattcaaacactaagagatatatacaaggtaaaattatatcccgctccagaagtaaaacgtttgttgtctactcttccacttccttttctgttcattttgcacctaaacatgtgtattttttacacttaaaaaaagcccatgtcttagagattctttccattgtgagtgcttgacattttatgaaatggaggtactataaattatttagccagttttcttttaatggatatttggtttattacttttttgctgttataattagtgttgtgatcttgtatgtttgttttctgattataagttttttatattagaggaatttctagaggtacaattgttgagtcaaagggtatggacatttaaaattttgagaggtaatatcaaagtattttgtaaaaaggcatcatgaatttatattcccacctgaagtttttataaatgtccattaccctgcactctcacccaaatttccatttagatttttgcctatctgatgtgattctaaaggaaacaggtttacttgacactatccttatattttattgagacatgttcaatggatgcatctcagttttatgcttttgagactctttttgagggcttgggtttttttttgtgtgtgtgcccttatgcatagtcaactagtaagctgtacattgattatattctcttttgatgtatgtgtttgtgtgtatctttatatatttaggtttatatcatcaaatttattaaaaccctttatattcatcttttctgtttattaaaatgtggacttttgtgacaggtatgttgaatcttatattatgattatgtaagtaattttcttctgttttgatactagttttcacattatgtattttaaagctgtgttattagaggaataaaagtttgtggcatgacaa

SEQ ID NO: 197143 - DNA, 1917 bp, Homo sapiens
  Payload ID: 18875
  Gene Name: ubiquitin protein ligase E3D
  Uniprot ID: Q7Z6J8
  ENST ID: ENST00000369747
  CDS Start-End: 124-1293
acaggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagtcagctcaggaggcatcaattacaaagacaagaaccagagctatgggataagagcattgcattgaagttttaagtttacttgtttgcatgtattctctaagagaagagttaactttagatctttgaaaacccaggactgtgaagaaagtcatagtagcaggttgaggcaagtgtagaagttacatctctatttcccacagagaggaatattcacatatgtgcagtgtcagcaccacctggaaggttattacctaatggagatccatctgtcctgtgtggaatccagtgaggaattttattggtggaactgaatgttaactgctgtaaatcctaggaaataaacttttaaagagtttctcaggatgatttaaaacaaattttaaaaaagaaaagtagaaaacattttatactttattcagaggagatgctcaatagatgtttgttgaatgaatgattatcaaattaaaggatttcctatttatgcaaatctgcatgtttcttttgttatttcctttaccatacattattgcaaattaataaatatacctcactagca

SEQ ID NO: 197144 - DNA, 1352 bp, Homo sapiens
  Payload ID: 18875
  Gene Name: ubiquitin protein ligase E3D
  ENST ID: ENST00000430071
  CDS Start-End: 122-490
aggcgcctgcgccgcagcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacagatgatttgaaacagagtggctctccggaggtctctggatggttcgccctgttctccctgcactggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaaggtcaggatgacaaagtgtatatcttgctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatg

SEQ ID NO: 197145 - DNA, 3255 bp, Homo sapiens
  Payload ID: 18875
  Gene Name: ubiquitin protein ligase E3D
  ENST ID: ENST00000505226
  CDS Start-End: 106-219
gcggggctgccgctggttggtccgcacgtggaacctctcctggtcctgttgacccgggcccctcggaacctccagcttggtccggtctgggactggaagcctgccatggcggcttctgcggcggagacgcgcgtgtttctggaggtgcggggacagctgcagagcgcgcttctgatcctgggagatagggtttcaccatattgcccatgctggtcttgaactcctggactcaagcgatccacccactttggactcccaaagtgctgggattacagagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcaggtaagaatttcataacaagaagccaaaatgattggcttcttgcttaaaagccagaatgatattttatagtaaatatataggaaagatagatgattaatatatgttgtggaattggtgcttttcaaaatagaccccaagtaacataccatccaatataccaagaagtttgtatattttgaccttcataaatacagagtattgaattttaagtattaagaagttgagtcattttcagagtttcatagcctctttgtagatataaagcaatagtataaagtttgttcttgggcctatttcaagaaaattggagcttttttctctctttgtttccttctttcttcttcttcttttttttttttttttaattttaccttcctggtaactcacgaaacagagcttttttcttaatacacctcctcagttagaagaattggtgcccagagatggagaagttgtttttcttggctgccatctggctcggggctgtattttggggctggggatgggagaggacctgttgaaatggaagaaaaaaaattccgaattttgtactttgtcccttattcttttggttccccagtagcattgattatattttatgtaaactctgttatactactttaaaatataataatgaaaatcctgataattaaaatgcattgctgtttaaagatatggtttatagtgtctagagaactacaacatgctgtgttagctttggatgatgaataattacttttaatacagttaattagaagatgtgatttacatgaagcaattgtacttaagggaaggcagatgatggtattttttgtttatttgtttgtttaatcgtcaaaatcttgtaagaagttacttgttcacagtgagccagaaaggaaaaatgagttagtaaaaggtaccatccttaacgtcatttttggaaaatgaaagcaagcctctgaagcaacaccttagaaaaagttaagccttctggttaaataaggtgaattgatttttaaattattttctccctgaagtcctgttaaaatgtcagttaaggaatgaaaagatatatatctacaaaggcaaagagaaatggagaggagatgacaatgacataaacaagagatgtaaacaaacttttttggaacacacttggcagcctggagggagctgcagctttggtgtctgtagatcatttggataaggagtgggccaataatctctgtagagccccaaaacaagtcagaatttggaggcagcaggtgacagggaaggcagtctgaggcaaggggctggaagcaggatgattggttcaaagtgtatatatacagctactagacttctaggtttcccacttcattttcaacttgcttctgtaatcctcaaggttggagattggaagacctcccccacaccctttttttttgaataatggaagaataccaactagagaaaagacttgcagacactgattctttggggacattcaaccaaaaatgaggttatgtcgttgttcaacaaaaatgaggttaaactgagcacagtggtgcatgcctatagtcccagctacttgggaggctgaggcaggagggtcacttgagcccaggggttcaaggctgtggtgcactattattgcacctatgaatagccactgcacttcagcctggagaacatagggagactctatctcttaaaaaaaaaaaaaaagagagagcttatattcactcatcctacagtcaacaaaccttgtacctatacccaagaactttctctcagcatttcactgccttacactaaaattgaaatgaattgttgagaatcaccaaatatttgagtaaatcaacaaaaaagaaaccaaggcaaataaatgattaagcaagcaaattaaaagcactgagaagaaacacattatgtatacagcagaagtaaatctttaaaaaaaaaatgcccttgaagaaataaactaatattgcttccataattcagagaatgtggaatttaaaaatgtaatagcttcagaaaaaaaaaattaaagaattggaagataaaagtaaagaattaggccagaaattaaaaccaaaagacagagattgaaaattaaagaagaggccgggcacggaggctcacgcctgtaatcccagcactttgggaggccgagatgggcagatgacctgaggtcaggagctcaagaccagcctggccaacatggtgaaaccctgtctctaccaaaaatacaaaaattagccagacatggtgacatgcacctgtaatcccagctactagggaggctgaggcaggagaatcgcttgaacccgggaggcaaagatggcagtgagctaagatcgtgccactgcactccagcctgagcaacagggcaagactccatctcaaaaaaaaaaaaaaaa

SEQ ID NO: 197146 - DNA, 1246 bp, Homo sapiens
  Payload ID: 18875
  Gene Name: ubiquitin protein ligase E3D
  ENST ID: ENST00000509102
  CDS Start-End: 34-888
cagcttggtccggtctgggactggaagcctgccatggcggcttctgcggcggagacgcgcgtgtttctggaggtgcggggacagctgcagagcgcgcttctgatcctgggagaaccgaaagaaggaggtatgcccatgaatatttccataatgccatcttcactccagatgaaaacccctgaaggctgcacagaaatccagcttccagcagaggtcaggcttgtaccttcctcttgccgtgggctacagtttgttgttggagatggactgcacctgcgactgcagacgcaagcaaaattaggcacaaaactgatttcaatgtttaatcaaagctcgcaaacccaagaatgttgcacgttttattgccaatcctgcggtgaagtcataataaaagacaggaagctcctcagggtgctcccactgccgagtgagaactggggagctctagttggagaatggtgttgtcatcctgacccctttgctaataaatcacttcatccgcaagagaatgactgttttattggagactctttcttcttggtgaatttaagaaccagtttgtggcagcaaagacctgaactatccccagtggagatgtgctgtgtttcttctgacaaccattgtaaattggaaccaaaggcaaataccaaagtaatttgtaagcgttgcaaggtaatgttgggagagaccgtgtcatcagaaaccaccaagttttatatgacagagataattattcagtcatctgagaggagttttcctatcataccaaggtcttggtttgtccagagcgtgatcgcccagtgtctggtgcagctctcctctgctagaagcacttttagattcacgattcaagctatggcttttaaattcagacagtttggtgattgaatctttgagaaattccaaatatatcaaaaaattccccttgttggaaaacacattcaaagccgattctagttctgcctggagtgctgtcaaggtcctctaccagccatgcatcaaaagcaggaatgaaaaacttgtcagcttgtgggaaagtgacatcagcgtccacccgctaaccctgccctctgcaacctgcttggagctgctgttgatattgtcaaagagtaatgccaatctgccttcatcccttcgccgtgtgaattcctttcaggtggcctttttgaagatgtaactattagagctgggcattctcctcccccggcagacagctctcaagcaggagcacaccgaggccagcagt

SEQ ID NO: 197147 - DNA, 114 bp, Homo sapiens
  Payload ID: 18875
  Gene Name: ubiquitin protein ligase E3D
  ENST ID: ENST00000626828
  CDS Start-End: 1-114
atggcggcttctgcggcggagacgcgcgtgtttctggaggtgcggggacagctgcagagcgcgcttctgatcctgggagatagggtttcaccatattgcccatgctggtcttga

SEQ ID NO: 197148 - DNA, 753 bp, Homo sapiens
  Payload ID: 18876
  Gene Name: ubiquitin related modifier 1
  ENST ID: ENST00000372847
  CDS Start-End: 11-202
cttcctcaacatggctgcgcccttgtcagtggaggtggagttcgggagctcacctggctgtctttttctctggtcctcctttgcagaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgtgagtcccactcctcccttccctgaagcaggtggagggagggacggatatttgagcccccaccctcgggttcagtcctggccttctctgaatccggttctccccttcctcctccctaactcttccagctctgagatctgttttcagttttcttgttactaaaccgaactcttgaggattttttaaatcccagatgaaaggagcctggtgaatttctcagaaaacttggattctgccctctggttgccacagacttgctgtgggaccttaggcgacttacttcgcttctctgggcctcagttactctctacacagaaagtgctgaggaaaaaacgtagctagtacaactgaagagctaaatattctgttttatttcattgtaatttaaatagccacatgcagctagtagattaccatacagtgcagcacgggtctagaattccaaggagtcattgactctgtgcgtgcacacacccatgcacatgcacacacactcactggggacaccccatag

SEQ ID NO: 197149 - DNA, 3045 bp, Homo sapiens
  Payload ID: 18876
  Gene Name: ubiquitin related modifier 1
  Uniprot ID: Q9BTM9
  ENST ID: ENST00000372850
  CDS Start-End: 21-212
gcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgtgagtcccactcctcccttccctgaagcaggtggagggagggacggatatttgagcccccaccctcgggttcagtcctggccttctctgaatccggttctccccttcctcctccctaactcttccagctctgagatctgttttcagttttcttgttactaaaccgaactcttgaggattttttaaatcccagatgaaaggagcctggtgaatttctcagaaaacttggattctgccctctggttgccacagacttgctgtgggaccttaggcgacttacttcgcttctctgggcctcagttactctctacacagaaagtgctgaggaaaaaacgtagctagtacaactgaagagctaaatattctgttttatttcattgtaatttaaatagccacatgcagctagtagattaccatacagtgcagcacgggtctagaattccaaggagtcattgactctgtgcgtgcacacacccatgcacatgcacacacactcactggggacaccccatagaagcccagtgcagtctccttggaaaggaccaggttccagttgccacgaagttacttctaaaacaaggccagtcccccacgtgaaaggtggccggtgcagttgtgaggctcgcttatttgcctcgaagcataggtcactgtcaggtcctaagggatcaggcctaggggatcagccctccttcaggtcatggtccagtggtcctggaggccacctctaaggccagcagtgctccttgggccattaccagtgggagccaggctaagctgcctgaccaaatgttgacctaccctgccttatgccaggcaggactgcacgtgagcattgccatgtggcatggcaactgattcggaagaggcaaaacagccttctctccaggatgggcatgcagaggcctaaaaaaaagccgaagttcttttccagggctaacgagaataagattagacccctggaaaagtcctactaatggttaccatgacagtgtggcaagcactccacacatatcagctcatttcgttttcgtataggccttgtgggttagacagtatcacttatcccattttcagatgaggaacctgatactcagaaacaaaatgacctgcccatggtctgggtggtggtgctggctggcatttgcacccattttccatctggctacaaagaccatgcatgactgacctggtttccttcacactcagaccagcctccccttcctgggatatctttagccagaccccaggaggaaggctcctcagcacactctcctgcagcccaaagctctcagcctctcttcctctgtgctactgcctcctgcctctcactccttgctactcaccaccatctttcccacaggcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 197150 - DNA, 2650 bp, Homo sapiens
  Payload ID: 18876
  Gene Name: ubiquitin related modifier 1
  Uniprot ID: Q9BTM9
  ENST ID: ENST00000372853
  CDS Start-End: 63-368
ccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttactagccttgcttggagcttcatccttggaaacgggtggcacctcatatccccccagccgtggtctgtgatacaacctctccatcctcagcctagggcctcagagctacccttcacccaaaagaggggtgggggtgaacactcagacaatctgagagggggtagtctaatagagccatctggagaagggagtggcagagccagtctgtgctgaccagtctgtgtcccgggacgcatccccacccgtctgtccaaggctttgtcccaccagctgcagccagcagcctcagaacccaaaatgagggtagcatagataagactgctgagccccctttctgtggtctttcctttccatgacctagagaaaagagctttgctggagggagacccccaaaaagaattagggtgctaacatcccaccaaaagcatcatcccacccaaaatgttgcttttcattctatgtcaataatttaaggtggaatttctctcaccctgtggagatgaaagtggcaaaaggttgtcccagcagtgttgggggatggggtgtgcacatcattcttttgggggtagatgacctgctggctggtgggcttttctccaggactactgcaggtagagaccctctgggcttgtgtggagtgggagcagccgtgttgggactatggggaggagctggtctgggtgcaaattaaggccagtgttggggtctgagtgctgtccagaaaggctgtgtgaccaaccctcactagttcctgaggtcagggtctccatgttagggaacagagcaagagacttggaacagctccctacagctgcacttctagaaggtcagcctgtccgattcttgtaacctggaggtccctccccatctgcagccccctgagctgcaggagcggccccatcagtgcacctgattggaacacactagatttcaggtcctggaaactgggcgctaggatccgtttccctggctgcagagagtgggaggtgtgatgtggaatatcccttctcccagcacaccccaattaatactgaagagtagggcaggaggaggtgctgggaaaaccgggtttcttggcacatgggggtgcaagcactgtggttgaaattggccatgtccaaggcacaccagacgatttcaggtcatttttagccctagactggaaaggggtcaggggacaggtgacctgggctcagcccccagcagctcccaactgcccctctcccaagcaactcctgatccctgcttttgaggaaataaacaaataaaaccccgctatctccgaa

SEQ ID NO: 197151 - DNA, 2944 bp, Homo sapiens
  Payload ID: 18876
  Gene Name: ubiquitin related modifier 1
  Uniprot ID: Q9BTM9
  ENST ID: ENST00000452446
  CDS Start-End: 1-441
atggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttactagccttgcttggagcttcatccttggaaacgggtggcacctcatatccccccagccgtggtctgtgatacaacctctccatcctcagcctagggcctcagagctacccttcacccaaaagaggggtgggggtgaacactcagacaatctgagagggggtagtctaatagagccatctggagaagggagtggcagagccagtctgtgctgaccagtctgtgtcccgggacgcatccccacccgtctgtccaaggctttgtcccaccagctgcagccagcagcctcagaacccaaaatgagggtagcatagataagactgctgagccccctttctgtggtctttcctttccatgacctagagaaaagagctttgctggagggagacccccaaaaagaattagggtgctaacatcccaccaaaagcatcatcccacccaaaatgttgcttttcattctatgtcaataatttaaggtggaatttctctcaccctgtggagatgaaagtggcaaaaggttgtcccagcagtgttgggggatggggtgtgcacatcattcttttgggggtagatgacctgctggctggtgggcttttctccaggactactgcaggtagagaccctctgggcttgtgtggagtgggagcagccgtgttgggactatggggaggagctggtctgggtgcaaattaaggccagtgttggggtctgagtgctgtccagaaaggctgtgtgaccaaccctcactagttcctgaggtcagggtctccatgttagggaacagagcaagagacttggaacagctccctacagctgcacttctagaaggtcagcctgtccgattcttgtaacctggaggtccctccccatctgcagccccctgagctgcaggagcggccccatcagtgcacctgattggaacacactagatttcaggtcctggaaactgggcgctaggatccgtttccctggctgcagagagtgggaggtgtgatgtggaatatcccttctcccagcacaccccaattaatactgaagagtagggcaggaggaggtgctgggaaaaccgggtttcttggcacatgggggtgcaagcactgtggttgaaattggccatgtccaaggcacaccagacgatttcaggtcatttttagccctagactggaaaggggtcaggggacaggtgacctgggctcagcccccagcagctcccaactgcccctctcccaagcaactcctgatccctgcttttgaggaaataaacaaataaaaccccgctatctccgaa

SEQ ID NO: 197152 - DNA, 723 bp, Homo sapiens
  Payload ID: 18876
  Gene Name: ubiquitin related modifier 1
  ENST ID: ENST00000470840
  CDS Start-End: 21-212
gcgagctcggcttcctcaacatggctgcgcccttgtcagtggaggtggagttcgggagctcacctggctgtctttttctctggtcctcctttgcagaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaagg

SEQ ID NO: 197153 - DNA, 3996 bp, Homo sapiens
  Payload ID: 18877
  Gene Name: ubiquitin specific peptidase 1
  Uniprot ID: O94782
  ENST ID: ENST00000339950
  CDS Start-End: 816-3173
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaa

SEQ ID NO: 197154 - DNA, 3507 bp, Homo sapiens
  Payload ID: 18877
  Gene Name: ubiquitin specific peptidase 1
  Uniprot ID: O94782
  ENST ID: ENST00000371146
  CDS Start-End: 329-2686
ggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcg

SEQ ID NO: 197155 - DNA, 502 bp, Homo sapiens
  Payload ID: 18877
  Gene Name: ubiquitin specific peptidase 1
  ENST ID: ENST00000442679
  CDS Start-End: 240-502
ggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaa

SEQ ID NO: 197156 - DNA, 893 bp, Homo sapiens
  Payload ID: 18877
  Gene Name: ubiquitin specific peptidase 1
  ENST ID: ENST00000452143
  CDS Start-End: 336-893
cggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagg

SEQ ID NO: 197157 - DNA, 3009 bp, Homo sapiens
  Payload ID: 18878
  Gene Name: ubiquitin specific peptidase 10
  Uniprot ID: Q14694
  ENST ID: ENST00000219473
  CDS Start-End: 114-2510
gcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacata

SEQ ID NO: 197158 - DNA, 3070 bp, Homo sapiens
  Payload ID: 18878
  Gene Name: ubiquitin specific peptidase 10
  ENST ID: ENST00000540269
  CDS Start-End: 97-285
gatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagtgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 197159 - DNA, 502 bp, Homo sapiens
  Payload ID: 18878
  Gene Name: ubiquitin specific peptidase 10
  ENST ID: ENST00000570053
  CDS Start-End: 52-502
aagcagcgtgagcagccggaggatcgcggagtcccaatgaaacgggcagccatggccctccacagcccgcagtatatttttggagattttagccctgatgaattcaatcaattctttgtgactcctcgatcttcagttgagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagaca

SEQ ID NO: 197160 - DNA, 1315 bp, Homo sapiens
  Payload ID: 18878
  Gene Name: ubiquitin specific peptidase 10
  ENST ID: ENST00000563048
  CDS Start-End: 88-195
gtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtacca

SEQ ID NO: 197161 - DNA, 590 bp, Homo sapiens
  Payload ID: 18878
  Gene Name: ubiquitin specific peptidase 10
  ENST ID: ENST00000563386
  CDS Start-End: 84-275
atgtgcgggcgagaagatggcggcggcgggggaagcagcgtgagcagccggaggatcgcggagtcccaatgaaacgggcagccatggccctccacagcccgcagatggagtctggctctgtcgccccggctggggtgcggtggcgcgatctcagctcactgcaacctcggcctccctggttcaagcaattctcctggctcagcctcccgagcagccgggactacagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttcta

SEQ ID NO: 197162 - DNA, 572 bp, Homo sapiens
  Payload ID: 18878
  Gene Name: ubiquitin specific peptidase 10
  ENST ID: ENST00000569925
  CDS Start-End: 1-229
ccagtcagacaagatacgcacagtccaggatgcactggagagcttggtggcaagagaatctgtccaaggttataccacaaaaaccaaacaagagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgat

SEQ ID NO: 197163 - DNA, 569 bp, Homo sapiens
  Payload ID: 18878
  Gene Name: ubiquitin specific peptidase 10
  ENST ID: ENST00000562283
  CDS Start-End: 146-569
gtgtatgtgcgggcgagaagatggcggcggcgggggaagcagcgtgagcagccggaggatcgcggagtcccaatgaaacgggcagccatggccctccacagcccgcagtatgtttggcagagaaagcggaaatggaggtagtggcatgagtcagcagaaagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaaggg

SEQ ID NO: 197164 - DNA, 330 bp, Homo sapiens
  Payload ID: 18878
  Gene Name: ubiquitin specific peptidase 10
  ENST ID: ENST00000567526
  CDS Start-End: 1-330
agtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagtggtctaccatcacggcaacagtgcgacgggcggccattacactacagacgtcttccagatcggtctgaatggctggctgcgcatcgatgacc

SEQ ID NO: 197165 - DNA, 2717 bp, Homo sapiens
  Payload ID: 18878
  Gene Name: ubiquitin specific peptidase 10
  Uniprot ID: Q14694
  ENST ID: ENST00000570191
  CDS Start-End: 197-2605
gtgtatgtgcgggcgagaagatggcggcggcgggggaagcagcgtgagcagccggaggatcgcggagtcccaatgaaacgggcagccatggccctccacagcccgcagctcctgggccatgatcccattttcatcagatgacttgagaacccagaagctctaccagcactgccattctgtcccgtcttgaaacatcatgccctggttgccctctcctggaatagggcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgc

SEQ ID NO: 197166 - DNA, 570 bp, Homo sapiens
  Payload ID: 18878
  Gene Name: ubiquitin specific peptidase 10
  ENST ID: ENST00000563892
  CDS Start-End: 97-570
gatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatgagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttac

SEQ ID NO: 197167 - DNA, 730 bp, Homo sapiens
  Payload ID: 18878
  Gene Name: ubiquitin specific peptidase 10
  ENST ID: ENST00000569038
  CDS Start-End: 107-730
ggcggcgggggaagcagcgtgagcagccggaggatcgcggagtcccaatgaaacgggcagccatggccctccacagcccgcagtatgtttggcagagaaagcggaaatggaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaagccatttttcacgttgcagttggatatccagtc

SEQ ID NO: 197168 - DNA, 3338 bp, Homo sapiens
  Payload ID: 18879
  Gene Name: ubiquitin specific peptidase 11
  Uniprot ID: P51784
  ENST ID: ENST00000218348
  CDS Start-End: 50-2941
ttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccc

SEQ ID NO: 197169 - DNA, 1077 bp, Homo sapiens
  Payload ID: 18879
  Gene Name: ubiquitin specific peptidase 11
  ENST ID: ENST00000377078
  CDS Start-End: 656-1077
gtgctctgaggccgagggacgacagtggaggggaggtggtgcctatgaggcagaaaatggcgcctgcgaataagcaaagtttatgacgcgccgtggtttttgattctggcggaagccttcccgagtcgagagaacgtgcaggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatga

SEQ ID NO: 197170 - DNA, 804 bp, Homo sapiens
  Payload ID: 18879
  Gene Name: ubiquitin specific peptidase 11
  ENST ID: ENST00000377080
  CDS Start-End: 657-804
aacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcgg

SEQ ID NO: 197171 - DNA, 3515 bp, Homo sapiens
  Payload ID: 18879
  Gene Name: ubiquitin specific peptidase 11
  ENST ID: ENST00000377107
  CDS Start-End: 355-3117
gatggtacaatgaagggcattctgatcaggctaacaaaaacactgctcccagggtaggagtcctagcccacctcgggaacctcagcctccactttccatgccacctgtgccctaagtctacagggcgttaggaccccacaaggcacttttgtctttcttggttcccactgaagattttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 197172 - DNA, 4511 bp, Homo sapiens
  Payload ID: 18880
  Gene Name: ubiquitin specific peptidase 12
  Uniprot ID: O75317
  ENST ID: ENST00000282344
  CDS Start-End: 258-1370
cggaggcagcggctgcgccctgcgccggggcggagccgggggcgggccggcggccggcaggcgggggctggggcccgaggccgggagtgcctgagcgccggcggcgacgacggcagcggcggcccagcgggctcggtggttgggtccgcggcggctcggggtccgcccgcgggctgcggtgcgagcgggcggcccggctcccctcctcccccgcccgccgccgccgctgtgattgggtggaagatggcgctggccggatggaaatcctaatgacagtctccaaattcgcctccatctgtaccatgggcgccaatgcttcggcattagagaaagagattggtccagaacagtttccggtcaatgagcactattttggattagtcaattttgggaatacctgctactgcaattcagttcttcaagcactttatttttgtcgtccatttcgggaaaaagttcttgcgtataagagtcaacctaggaaaaaggagagccttcttacatgcttagcagatctcttccatagcatagccactcagaagaaaaaggttggagtaataccccctaagaagttcatcacaagattacggaaagaaaatgagctttttgacaactacatgcaacaagatgcccatgaattcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaagtggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaagcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaaggggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacagatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtgcctgtgggtttcaa

SEQ ID NO: 197173 - DNA, 349 bp, Homo sapiens
  Payload ID: 18880
  Gene Name: ubiquitin specific peptidase 12
  ENST ID: ENST00000620323
  CDS Start-End: 63-119
ggctcccctcctcccccgcccgccgccgccgctgtgattgggtggaagatggcgctggccggatggaaatcctaatgacagtctccaaattcgcctccatctgtaccatggagtggtgaatcagatctgaaagatgccttaaaaagcagattctctactacacgctgaggaacagtacaaaaaatgactgaaatcaggtggacataaaatcgacagtattaaagaaatcatattgaaggatgaatcattgaagactccatttcccaactggatgattgttctttctcacagtttacattttaggaaagcatttgtattaaatggactatattaaaatgattttggagaa

SEQ ID NO: 197174 - DNA, 712 bp, Homo sapiens
  Payload ID: 18880
  Gene Name: ubiquitin specific peptidase 12
  ENST ID: ENST00000612674
  CDS Start-End: 1-271
taatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggtaattttagagctttatggatttttaagtgattttattttttgtaattgatgttggaggtgggcttagaaaaacaatctaggaaaatttacattgagtaaaaattcttaattctatcactaacagttaatgttcattaagtattactaggtaaatgatattctactcaatgtttattttacaaaaactgtgtaccctgaagtgatttcctatgtctagcgattatttaatcatcataaaccagtacagttaaaatatttggctttgaggctttcctgatgatgtaaacttttttcttggtgaagagggttgagggagatagcactccccattgcccatcccccacacccccagtttctgcttttcctacataggatgttgtacattctcttagcatgttattgtaagactggtttggtatcaataaatggaataataaacatca

SEQ ID NO: 197175 - DNA, 8323 bp, Homo sapiens
  Payload ID: 18881
  Gene Name: ubiquitin specific peptidase 13 (isopeptidase T-3)
  Uniprot ID: Q92995
  ENST ID: ENST00000263966
  CDS Start-End: 472-3063
ggcctcctcggagttgcccctctgcaagccaacaattcgggatagaaaacacctccgtggtgttttcccggggccctcccgcgccgcgttcggccgccagcccgctcgagctcccgcgccaacgcctcaggggttcgccctccgccccccgccgccgcgcccggcccacgcgcagggcccctctccagcgccccctccccggcacgctgcggctggcgctccccagccccgcctgacgctgcagctgggccggagactcgccattggattaaaaatagcgtcgccagtccgccccaagcccgcggtgcccgctcccgccccgcagcccgctctccccgcccgccccggctcggccggctgccgttgcccgcgcagcccgcccgtcagcccgctcgctggcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaagaagaagaagaagttgaaacaactagacatgaaggaatatatggggtatttatcgtttatttaaagagcacgatcagttgacaccttctgaaatagaactgagaagaaatttctattagtgatgatacactattatattgtagatagtttttataaatgttcaaaaagatgatgatatttaaaaacaaaaaaagtattcatattgctggtggaggatctgccatcagcacatcaaaaatggggatgtgcccccagccctctattttgctttgggggtcagtgatagtggcctctggagaaaccaaataatgtggccagtggtgtggccttacccacaacaaatgaaaagcccacttgtgtttcatatagaaaatcagcagttgggtggggctttatttgtgacataatttttttcatgacatacaataatttctgatgtatccatgtagatattatgctctgtccataatagagcctctgcaatgaaagatatttttaatttgtcacattaaaattcataatacgattgtgtgaatgtgtgtgagactgactgagagtgtgagacttttactagaaaagtgagtccactagaaaatctgtgacaagttggtttttaaagtctgaacagttgatattaagcatatctgaaaaaagcaagtaaatattttaacaaaactatgactcaggaaccttcgagaagattagttccccacttagatttttaaggagtaaaaagggctgagttatgcctttaagtgctgtcaagaattcacttgggtttgggacatttgctggtgtaatgctagatgcccacagcagcataatattgtactttgtcaaaggtaggtaaattctctgtttctcagcagccctttccccaaaaggtatggtgtttatttttagtaaaaatagctaatctctttttaccatctcacatgataactctttggagtcatgtcaagtgccccaaatttgtctgtgattttcccatctctgagctctttatctgcctccgtttccttgtttttctggggccagagtctcatctctgcctttttttggtgtatcaccttctgacttgccttcattgcttgtctgatgtgaccaacagtgtgatcttggacacactaaggattttagatgcaaagaaactttatacaacattatgaaagactatcctttccattttggttatttcagcattttagttgcaacctgggattagattagagtttccaacgtgatgaaaagtggaatgatagcattctataatttccataattttcctactggtccgtaccaaattctagagtctctggagttgctatttcagagtatttggtcaaacgaaaaagaatttattgctgtctgtttaacatgtatttgtttggttgaaaggatctttttagaaactgtaggaaaataaacagaaccaaccaggtgaaacaaagcacagacattgggttaggatgtagtgagttgtgaacaatcaggattctgggtgtgatgggggtccctgtctcataggtgatcctttggtgccatgtgaccgagagacatggtgtctaaggcccatggcctggagacctgggtgctgctcctagctgactgtggaccttgggcaagtccttcatccgtcctgtgcctcactgtcctcatctgaacaatggtatgatgacacctgccctctctttcaatcatgctttgaggatacagtgagattggttacagtgaaccttcaatgagtagaatgtggtatgccatggtgggttgtagtagatggtgctccctgccttttctcctctgttttcctcaatttgggaacaaatgagattggcagaaggagggagctcacggtgcagtacttttctaccaaagtgtgcccactggtgtcacctcctaatgttaacttggatttcctaaagcagtcccactctgttatgagagtcactgactcccgtggacatccccacagtaagcagccttacaaaatccagtccccttagggcagagtgagtgtcatagaataatgactccaaacccacgtcaaaaatggcttgttttcagcgatgttataaaacaaaggcctgttttttggaattgggggtgactgggtggtttggattgaaatgtggacaaagatagcatgtgtattttgaataaaataaaaattttgtaataaaacttttaaaaatcagtgatgtaaaatcaatatttaagactataggctataaattgtttgatttcattaactagcccttttgatgcctagacatgttgtaaaaaaattgtgctatggctgccttttcttctgccccacaacacaaagggctatttctacaaggcaaagttttgtatatgtgctattctttacttcagattgagagttgggaaaaactggagtaaataatgggtttcttacttgcttaaaagcatatttatatgtgtatctcaatatatacaaggcaggttcccctataaaagtctggaatgtactgcttaattttacacttgtgtagacacgattatttgtgactgaaaagtggaataacgtgtggattttgtcaactcattatcagtctgttagcagtcctctatgtgaggcatggtggtctaattgtgaaattctccctgtatatgggtgtctgtgtgaaagacagcactttcttcctgtaaatatcttttgatatccatttatgtagaattccaatgaatatgtctttggaaaaggtaatgtatcaaagtttttattttgccaattgatctaaatgcccatataactaatcagaaatccagtttggttcagattgggattttcttttaaagaaaaaaaaagtatgcagaaaagactattggaagaatcatgtgttagtgacactttacatcaacgttgcttcaatattttggaattgaccaggctgctttctcctacctgcaagagaatgtgcctgacatttcccagtgcttactttgggctataggaagtccagcggggatagctcgagcctcttgctccctgagtcatttattccctttacctgaacagagccttacctgcaattcatagtgagagcacctgggtctgtatcctgactccactctaagtgaggtgggactgaatcactgtacctctctgggccttttcatttgaaacaagtgggttagactagattagctccaaagtcctctcttgccctaacattttatttttattttcctgtggttaccactagggtctgacacgtaaaatgtgagggatcacttagaggtttggatgttatatttttgcattgttacagcttatactccccagttgaggacctgtgtcattcttagtggccccacgacccctctgtttgtattcctgctccacttatctatacttttttgggtaatcatcccactttttttttttcttgagatggagtctcgctgtgttgccaaggctggagtacagtggtgcaatctcagctcactgcagcctcctcccgggttcaagtgattctcctgcctcagcttcccaagtagctgggattactggcgcacgccactacgcccagctaatttttgtatttttagtagagacagggttttgccatgttggccaggctggtcttgaactcttgacctcaacctgcctcagcctcccaaagtgctgggattacacgcatgagctaccgcgtccagccccactttttttctactcttgaaaaaaacaactttctagtccatgaggtactttggctccatccccctcaaaaacaaaacaaaaaatccatttaaagtgtcctcctagaaaagcctcagaactgccttcaactacatctgtcacctttatagaatattttgaaattctggaagaggatgggaaacaaaattctaatttagctagagctgtgatccccaaataagtgctgacaaaattgtctaccacagaaaggccgtccttgtcatcttgtaggcatcactgctgctaaatcacatcagtacatgccttctgtggggagatggcagggggcaggggcaggaccaggggatgggattagataaagtgtgataatgtcctttagataaaagaaatcctacgctatagaacaaggttctgtactcttgagttggtgtctgagatcacctgcacagtgttacagagattttccactccataaatcactctaaaagagtttgcataagactcggtagacctgtgctattcaatgtggcagtcaacagccatatgtggcgatgactactcaaagtttggcttgttcaaatcgagactgtgttgtacacatacaatacacaccagattttgaaggcttggtaccaaaaaggaatttaaaatatttcaccaatatttcatattgataacatgctgaaatgacactattttggatgtactaagtaaaatattaacaatttaatatatttatataattgaaattaaaattcttttcacccatttttatttttttaaaaatgtggcccctaaagaacttcaaattagacatgtggataacgttatacttctattggacagccccactctagacttacatggtgtggggtaggcagtgaaatccgtaaataggaaacgcaattctgcaaagtatctaaatagacagaaacaacacaaatatttttgctggagtcaggagcactgtgaggcacagaacatctcccagaaagcagattttttttttctgccgaaaaaccaatatatatatgtatgatcccaattaaaagacaaaagcaaatgagccccaaactgcctgtcttcagctttgcctgggagctgctacctttgctcttctagcatcttctaggtaccaaggatattagccacttgagggtgttgggcatatttgtttcattgtaggcaaaatcctcttgtggtttcccctccccaggtattgttgagtctgttcaaagctgggtgtgttgaaacactgcacaaatcctgccactcttgatgtgccgcttgtctcagccttggcagaggctgagtctgttcctgtgcccacctgtccagcaggttttgatgttggctcctgaaagagtttgtatttattttattttgcactagtcacagttgttgttaaactgtatcaaatgttttgggagattatttgcctgagatggaaagagagatggatgatttattgcttcaattgttttaaattaaaagctattctcacaa

SEQ ID NO: 197176 - DNA, 2747 bp, Homo sapiens
  Payload ID: 18881
  Gene Name: ubiquitin specific peptidase 13 (isopeptidase T-3)
  Uniprot ID: Q92995
  ENST ID: ENST00000496897
  CDS Start-End: 86-2482
gttccgaactgcacgttgcagatcgtttgcgtcctccgcggggcagagcgcagggcggaattctgaaggtggactctatgtatgcatgaatacatttttggcctttggaagggaacatgttgaaagacattttcgaaaaactggacagagtgtatacatgcacctgaaaagacatgtgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgccaaaaaaaaaaagaagaagaagaagttgaaacaactagacatgaaggaatatatggggtatttatcgtttatttaaagagcacgatcagttgacaccttctgaaatagaactgagaagaaatttctattagtgatgatacactattatattgtagatagtttttataaatgttcaaaaagatgatgatatttaaaaacaaaaaaagtattcata

SEQ ID NO: 197177 - DNA, 509 bp, Homo sapiens
  Payload ID: 18881
  Gene Name: ubiquitin specific peptidase 13 (isopeptidase T-3)
  ENST ID: ENST00000497380
  CDS Start-End: 1-228
ggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgtgcgagagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgc

SEQ ID NO: 197178 - DNA, 899 bp, Homo sapiens
  Payload ID: 18881
  Gene Name: ubiquitin specific peptidase 13 (isopeptidase T-3)
  ENST ID: ENST00000497155
  CDS Start-End: 1-899
ttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagcatcagacatcgatgagtcatcagtgatgcagctggccga

SEQ ID NO: 197179 - DNA, 4921 bp, Homo sapiens
  Payload ID: 18882
  Gene Name: ubiquitin specific peptidase 14 (tRNA-guanine transglycosylase)
  Uniprot ID: P54578
  ENST ID: ENST00000261601
  CDS Start-End: 92-1576
gccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatctcaacattagagttgtgctagattactgcttgactgactagctaggttaggcctaagagtgtttaccgaataatctgcactcactcagtagcccttcttcaggattaaaaacgatgatgacctcatcttagagccctaaagggaaatgcttatgtgggaacaagaaaagtcggtggtactgtcttctgctactactacttagtgctttgctgtgtatagggtgtgttcacatatatctcagttgaatgtcacaagaatccctgaagtgattaaaagtcttgagaggtcaggcaatttttgtaaggctagaaggaaaagtgaggttttagacttcatttcttttaaagttggcaaacaaacattttctgtaatggacaagatagatagattagatagatagatagatagatagatgatgattgattgatgattgatagtaaattatttcaggctttgcaggctataaagtgctgcagctccttagctttgctgttgttatagtgtagctggagccatagacagttagttagttagttatgagtgagcacagctgggtgccagtacaattttaatgatcaagactcgtggcaggcagaacaaaccatcatttgttgatcctctgcttgaaagcacgaataagtgagaacagagcagtcatatggtttcagaaagtgttattctgggatttcaggataaattttgtaaaactactaacaaacaacacacaggaaactaatttggtataagaaacgacatatccctaaatagtgcttatttaacttcattataaatacatctacttaacaaaaaaatatattttgtgatcttgaggtcacttcgtttaggtcattatctcaacccaacctccccaaactctggtttgagccaatatgtgttctattgttctcagagcaccagccgactgtacaacaattgttataaaaatgtttattgtttaccaaaaccagtggacctcttatcaaatgctgcttggtaacaaaatctatcacagttttaataaaaagaaaaaaaaaagaagctaa

SEQ ID NO: 197180 - DNA, 2168 bp, Homo sapiens
  Payload ID: 18882
  Gene Name: ubiquitin specific peptidase 14 (tRNA-guanine transglycosylase)
  ENST ID: ENST00000383589
  CDS Start-End: 109-1455
accgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaagatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgctt

SEQ ID NO: 197181 - DNA, 1681 bp, Homo sapiens
  Payload ID: 18882
  Gene Name: ubiquitin specific peptidase 14 (tRNA-guanine transglycosylase)
  Uniprot ID: P54578
  ENST ID: ENST00000400266
  CDS Start-End: 164-1615
gtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaagggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatcc

SEQ ID NO: 197182 - DNA, 503 bp, Homo sapiens
  Payload ID: 18882
  Gene Name: ubiquitin specific peptidase 14 (tRNA-guanine transglycosylase)
  ENST ID: ENST00000581983
  CDS Start-End: 419-503
aggcaccgtcccctctcccggctgggtcggagccctgcgtggcaggggagcgccgtccccctgagccaccgatgggtggggggagtggagatggggaagcctctcaaagtcgtgactctgcagaatagtttctgacgctgccctggtgtgcggtgaaagtgaggagacaggctggtctcgaactcctgacctcatgatccgcccgcctcgacctcccaaagtactgggattacaggcgtgagccaccacgcccagcctgctgaagtctcagtttctttaactatgaaatgagaagttaggtttgatccagtgaaattttattcagcacctactgcatgcatgctcctcttgattagttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaagg

SEQ ID NO: 197183 - DNA, 474 bp, Homo sapiens
  Payload ID: 18882
  Gene Name: ubiquitin specific peptidase 14 (tRNA-guanine transglycosylase)
  ENST ID: ENST00000580410
  CDS Start-End: 413-474
gaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgagacaggctggtctcgaactcctgacctcatgatccgcccgcctcgacctcccaaagtactgggattacaggcgtgagccaccacgcccagcctgctgaagtctcagtttctttaactatgaaatgagaagttaggtttgatccagtgaaattttattcagcacctactgcatgcatgctcctcttgattagttactgtaaaatggggaaaggagaaatttgaaggtgtagaattgaatacagatgaacctccaatggtattcaaggctcagctgtttgcgttgactggagtccagcctgccagacagaaagttat

SEQ ID NO: 197184 - DNA, 1803 bp, Homo sapiens
  Payload ID: 18882
  Gene Name: ubiquitin specific peptidase 14 (tRNA-guanine transglycosylase)
  Uniprot ID: P54578
  ENST ID: ENST00000582707
  CDS Start-End: 317-1696
ccctcacttgctccctccttccttcccgccacccctccaccgccttccccctcctccctcctctcgccacctctaggccccgccccggtcctgccgcccagtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcac

SEQ ID NO: 197185 - DNA, 578 bp, Homo sapiens
  Payload ID: 18882
  Gene Name: ubiquitin specific peptidase 14 (tRNA-guanine transglycosylase)
  ENST ID: ENST00000583119
  CDS Start-End: 1-100
tgcgttgactggagtccagcctgccagacagaaagttatggtgaaaggaggaacgctaaaggattttcatgaaattactttttttaaaaacagggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttct

SEQ ID NO: 197186 - DNA, 14950 bp, Homo sapiens
  Payload ID: 18883
  Gene Name: ubiquitin specific peptidase 15
  Uniprot ID: Q9Y4E8
  ENST ID: ENST00000353364
  CDS Start-End: 78-2936
gtgggacgccattcccataatgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccacttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggccttatttagtcttttatttcttactcttaatcttttaataaaaatcccctactttatggttagatgactatatgctagactttttagttataaatagttaatactagaaaggaaattatgtcagagcaaaatgaatcctactattaaggacgttttaaagttgatttttgtccactttaatatttattcattaaacatatgtttgtgtaccaatcactgttgtagagtctggagatacagcagtaaacaaatatccttaccttcacagagcttacattctttctgccatctaccaactaatgaactatatttccatttttctgaagatttaaagaaaagtcaaagctaaatcttttaaacctatattgtggtctccatcctaattcttcagagaccactttctttttaatgcctgtcattaacttctgttcccactaaaagaagtgatgttaataatgccattgaaactgccaaactcaaatgtcatttttcagctgcaagaagtatactttaaaaatagtgcaaaaggataatacatattctaattaaaagtaggcattcagactgggcacggtggttcatgcctgtaatcccagcactttgggagactcaggcgggaggatcacttgagcccaggagtttgagaccagcctgagtaacatagtgagaacctcatctgtacaaatatatgtatttttttttaattagctgggtgtgcacacacctgtgttcccagctactggggaggctgaggtgagagaattgcttgagcccaggcagtcaaggccgcagttagccgaaatcacacccctgcactccagcctgtgcaacatagcaagactctgtctcaaaaaaaaaaaagatattcataggtaatacagggtaatgggaatatatctagactagaatttctacttctagctttgccacttagcaatcatatgactttgaacttaatctttgatagtgtttctttacctgtagaataatgatgataatagccagcatttattgagcacttactatggaccaggcactatattaaagtgtttatatgcattctctcatttaatcccacaacagctatgaggtagggatagttgtcatccccatttttcatatgaagaaaccaagatacaaagcatttaagtaatattcccaagctcacacaattgctatggggtagagccaatattctatcctcagatatatactacctctcactgtgttatagtgtctgcctcataggattgttgagagctcaaatgagatcatgtattttatgggaagagctttgtaaactttattacacactcactgatttcttcagtctaaatagaaagacatcttgaagtctaataactttgcttctaaaagtatatttagctcagtattcgagcattgaataagaaagtacccactggaatattgactaacccattcccttttaaaaattaatttcatttaatttatatacctttattacaattttaattaaatggtaaatacaatgtgacatttttttcttaccttttcatctaacttgtgtccccttctttccatttccccaaatgcaaccctgaatttcaggactttgtaaactctactctagttttgctttctgtttgtttgtttgtttgtttagagacaaggtctccctctgtcgcccaggctggagtgcagtgacataatcatagttcactgtaaccttgaactcctgggttaaagtgatcctcctgcctcagccttataatttagttttaattaacctccttgaaaaagttgcagcctggtgctttatttaaatatcttgctttctcataatctgtgttattttagtagtcctgtatttatccttgctttcctgacaactggatataaaactacacaaaacattgatttgggcacaaagaaaatcagtaagtaccaaaatagatacaacataaaggtggtggggttttttatgaactaatttgattgaagtgagtttatcttataaaataagccgggagactgaaatggagtctccttcagtggtacaccaaagggagtgtagggtgtagtaggagctctctgcctccgagaggaggaatatattagactgataacgtttaagtctgatgtatggtgacaagaaaaaggccaattttttgttttgttatttttaagttacctacagataatgcatttcattattgcctacttccaactctccctatgtagtatgtttctgatcttctgtgcttgtgcagtgtagatgagctcaccgctttaatttttaagatagaaatgtggaaaactcttgaatcatagactaggggaaggaaccagaggtcctctaaaatatcagaggagtgagaaggaaaggaagagctcctttctagggccatagaataagagtagaagtttttgctcattttttttgtttgtttttactttacaaaaaaataaaaaattttttgctctttgaataacttaacatgaggaatttggaaacaacctctcttgaaaatatattggtattcattcccaaataattcttctaagtaccacttgaccagaggatagggaaaggaggaaaaggtgagtgtatttatatccttgctagtttttgttatatattcagttgcagatctatattatatatcattttattatcagattttctagtgagaaatatatatgatggttttttaataatcattttaggtttggaggccatttcaattcaatatgtatgtgttttacgtgtttaattcgtatttactatatattaaaagaatttccaaatagctcagataagaaaactttggtttaaaattgagttattttataagctacatagaatacatcaaaattttataagctgcatagaataggctttaaaatatcagaattaggaaaataaaatatagatggtaaaaattcaaatatttatcaagacttttttcttcactaatgatggggtaaagaatttttaaatggataatataaaacagacagttcaaaaattatttttggaaaatatatgcatcgggaaacataccccacacggtgccatggtttaattattccccagctctacttttgggagcctggaacttgtcagggttgtgaaatagatctcagactattaaggacattcagaaactggctaagccattcaaggaaaatcaggaatttacgtaatatattggactacagtctcaaaggacagagagaaaatcagtcaaatgggttttgatatttttttttcctagaaatgtgtagcaaatgtgattttacaaagcagctaaaaatacaactatctctctggaattgaaaatgtgtaaaataagaccacacactttcaatatgcacaaaatatattttaaatgtttaagttgtattggtaatttactatgttctcctgtagaaaatcataattaaagttggtgctcgtgttgctaaagttttttttctcatgtcaggaacttgcagcttgttctatatagtttggtgaaacaaacaaaacagtttttatctgctgtgacatttaagtttgttgttagctggagttaaatctacatacataaaagtaaaacaataaatatggaaacatcccaacagtctttcccacaatgtgtattattacattattctcagtaatgacacatacttaacatttcccaagctgttgttttaaaccttaaacatcaccacatttctaatttttatttaaaatctttcagaattcttagattttgtaacatatcaagcacaagtctctcattaaaatttttttttaatagtatttgcttttcttttaaactccataaaggagtattcgatgttaacagacgtaactctttaatgctcctctgttcatgattaagtatgctaagttttaagtaatttagactaatgtattaaagtgttcacttatgtctagtcatatgcatacctactctcttctaaccttgagtcatttctattaaatacagcatttaatcttctttcaagtgagaaccatctttccattatatcaagtgggcaatatttaaattgtctgataagttcatccaaattaatcccatcatgcctgtttaactcatttccccaaaaagaccgcgacctccagccagtcattcagttcttgaactccctaatagaagcaccaaggattatctatttgtaatcacattgtggtgaattatcagtctcccaagaattatgtaaagcaaataggaattattttagagttgcccttattttaaaaaacaaaaaaaaagtaaagatgggaaaattacttatagtatttttttttaatttgagaaagaattcctgtaggtctcccttaaatagtgactttggtaaagctttttaatttctagaactcagagctatattcacttttgagctatgtacctattgtataagttgaagtaatactgcaaattcaaacagtaaacatcattaatcctagatatttgggtactacctacagtgagatatggtaggaaacattctacacttacaacaacttccaccatagctagctccaaacaggtcattaacctctgaattactgttttcacaaccataaaattatgctggtctcttgaaagtattagtttatgggtgtggagaggaaggcttaaatttcatttttgaagctgtcgttaaaagtatatatttttagcaaaggaattaataactaatagcattgatgagtcaagttaatatttgtttttgtttttttttttttttaattttgggcctcactcctataaaagacttggaacagaagtcttagtatgatggtaaacttgaaaattaaaattttatcagggatattagaatccaattatatgagactgcatcctcaacaggcaccttggttgcaacaccatgaaagaccttgatccagaggttctcagcaagccacacctgaattcctaacccacaaaaactgtgagataacagatgtttgtgtttttagctgctaagctttaatttgtttatgcagaaataagggaaaaggaccctagagatccttgaggaatcccactttacagatgtagaagctgagggctagaaggagaaaagtcatgtacacaaagtctggagacaactcagatagtcactacatcctcttgctctttctcatttttactctttaactggctcctcactttttagatggatggcactgggctctggagcaaaccatctgttctgtatctgttaaggcctctagagcttcattcattccttcatcaaatattttttgagtgtccactatgtgccaggcactattctagattcaagatataaagtaatatacaaaaacaaaatccagttacaaatataatttttaaagctatttgtgagcataacttcgtaacacatttagaacctttgccttcagctgacatgaattatgttgtctttttgttttttggtccagtttcattagtcattaaagtcatttgaattaaagacaataatccagactccagaggttatggcttttatgtgtttggatactgtcatagtctgctcaggctgccataacaaacacagactgggtggcttaaataacagaaatttatattttcacagttctggaggctgggaatctgagatcagggtaccagtatactgggtttctggtgagggtgcctttcctggcttacagatggctgccttctcactgtgttcttgcatggtagcagaggagggtcagagaggagagcaagctctgaggcatctcttttttataagggcactaatcccgtcatgaagccctcaccctcatgacctcatctaaacctaattatctcctaaagacttcctctccaaatactatttaaggcttcaacctgaatttggaggtgacacagttgagcccatagcagatatatttagtaacaactgtgggtacaggcatgcctcagatattgcaggttcggttcccagccaccataaatatttaaataaagtgagtcacaaattttttggtttcccagtgcatataaaaggcatatttaccctatactgtagtctattaactgcaataacattgtgcctaaaaaagatgtacatgccttaattttcaaactattgccaaaaaatgctaaataaccatcagagccttcagcaagtagtaatgtttttgctgatggacagtcttgcctcattttgatagatactcaccaggatggtggttgctgaaggttagggtggccgtggcaattttttacaataagacagtagtgaagtttgcttcatcaattgactcttccttttacaagagatttctctggcatgcagtgctatttgataatatttgatacccacagtagaacttctttccgaacttctttcacaattggagttaatcttctaaagccccgccactgcttcatcaactaagtttatggaatattctaaatcctttgttgtcttttcaacaatgttcacagcatcttcaccaggagaagactttccccccttcttttcacagatgttgagattgtcaagaaactactttccttgcccacccataagaagcaacttatcatctgttcaagttttatcataagattgcagcaatccagacacatcttcaggctccacttgtagttctcttgctattttcaccgcatctgcagttactgccgccactgaggttttgaacttctcaaagtcatgaaagttgtaattaacttctttcaaactcttgttaatgttgatattttgactcccatgaatcacaaatattctgaatgaatggcatccagaatagcaaatccttttcagaaggtttttattttgcccagatccatcagaggaatcactatctatgaaagcttttgccttataaaatgtatttcttggatgataagacttgaaagctgaagttattctttgatctatggctgcagaatggatgttgtgttagcaggcagaaaaacactaatctcatacatctccatagagctcttgggtgaccaggtgcacttgtcaatgagcagtaatattttgaaaggaatctttttctgagcaatagatctccgcagtgggcttaaaatatttagtaaaccttcctataaacggatgtgctaccatccaggctttatggttccttttatagagcaaaaacattatatttagtttaattttaaggaccctaggatttttggaatgataaatgaacattagttagcattgcattggcccctaacaagaaatcagtctctcgtttgaagccaagcatcaacttttctctagctatgaaagtcctggatgacatcttccaacataagactttcatctacattgaaagtttgtttttagtgtaactaccttcatcaatgatcttagctagatcttctggataacttgctgtagtttctactttagcagttgctgcttcaccttatgcttgtctgttgtggagacagcttgtttccttaaactccatgaatcaaccactgctagcttcagacttttcttctgcagcttccttaccttagcctccatagaattgaagagagagggccttgctctgcgttaggctttggcttaagatagtgttgtggctgatttgatctattaaaaaaaaaaaaactcaggctttctctataccacttttcttatgattcatgtgttcacttgagtagcacttttaatttcaggaactcttcctttggatatacaacttggctgtttggctcaagaggcctagctttcagcttgccttggctttcaacatgctttcctcactaagctccaatcatttatagcatttgattgagagagagagagagatgtacagctcttcacctgaacatttagaggccattggatggttattaactggcctggttttaatagtgttatgtctcagggaatagggaggcacatggagagggagagagatggggaatggccagtggagcagttggaacacacacgtctgtgccctcaaacaaaacagtaacatcaaagattactgatcacagatcaccgtaacagatacaataataatgaagacatttgaaatgtgagaagtaccaagatatgacacacacacagtaagcacattctgttaggaaaataacacctatagatgtgctcaatgtaggcttgccacaagccttgtttgtaaaaaaacaaaaacaattatcttcaaagcatgataataaagtgaagcagaataaaacaaggtatgcctggtttttgttttgttttgttttgagacaaggtctttctctgtcacccaggctggagtgcagtggcacaatctcatctcactgcagcctccagcctctgggctcaagtggtcctcccacctcagcctccgaagtagctgggtctacaggcatgtgccaccacaccacacctggctaatttttgtagagaccaggtttcaccatgttacccaggctggttttgaagtcttgaactcaggcgatccatccacctcggcctcccaaagtgctgggattacaggcatgaaccacagcacctggccatgtattttcatttaaccagtactaaataactacatgtctttggcagcctataatgtagcatcccatttttaaaaatagaagtgtgtattcagggtgcactcaataggattacatctggctggcagtcccttcctacttcagtccattatcctgctaccagaatgatcttcatggtttcatttaaaaaaaaaaaaaatgagatcctgtttctgtcttaaagttctcttctaattccttgtattaatcaggattctccagagaaacaagaccaataggatgcatatgtgtatacacatatatgtatagctctctccctcatatatacacatatcatgtatatacatatatatcatatatgtacatatatatatatatatatgagggagagaaagatttataaggaattagttcatgcacttaggctgagaagtctcatgatcttcagtcagcaggctggagacccaggaatgccaatggtgtagttcaagtccgagtccaaagggttgagaaccaggaaaaccaatgataaaagttccagtccacaagctacctggctaaagacccaggaagactgaatgtttcagttttagtgcaaaggcaggaaaagactgatgtcccagttcaatcaggcaagagaaattatccttacttgagccttttttgttctattcaggccttcaattcatgagagccaccaacattagagagggcaatctgccttactcagtctactgacttaaatgttaatctcatccaaaaacaccctcatagatatgcccagaataatgtttgaccacatatctgggcaccctgtggcccagtcaacacattaaataaaccatcacatcccttcatgtagaaaagagtggtttggaccataggctcaggagttaaaccacctctgagcctaccacttttgtgcaactcacctcacctctctgcctttcacctctctgtaaactagagcagctcccgaatgtccatctaggaaggcttggggtgagcaacctgattagaagggaacaatgtgacttaaaactgcatatttgcttagcaaacctatgacttttctcagaatatacagtttgcttgtgatggagggctattaatatttataaggaaaccaaatccccattcacttaagccatccactcctaccactgtaattgaatattacctacctttcagaataattgcaaggttttgtgtcttgatcattatgaaaaatgtggcaggtattattactaataaagaagtacccaactatgggaatgattgttccttccttatgaatgagagcagctctctgttcaatacgattcatactcaagttctaataaactttctttagcaagagagcaaagagtatggtacagtcagtccacccaggttgcctgttaacctggtgcttgaaggaaaaaaagtaagaatttgccctcatctaattcctcacttgccctcaaacatgtcatactacttgacaatggggctttcccacatttgtcccacatttgcatggtctgccttatctcttacctggcgaactcctacactccttcaagacttgctccaaaatgcacttgctagatcttctgacatcaactgccaccttgggctataagttacgtgtgtctcttcccccactagacaattacctgatggaagaatattgttcttaagatgttaagatggtgtatgtgtggcatagtatttgttcctaaatgtaaaagttattaaacaagttttctgaaa

SEQ ID NO: 197187 - DNA, 4748 bp, Homo sapiens
  Payload ID: 18883
  Gene Name: ubiquitin specific peptidase 15
  Uniprot ID: Q9Y4E8
  ENST ID: ENST00000280377
  CDS Start-End: 59-3004
atgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccacttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctta

SEQ ID NO: 197188 - DNA, 2226 bp, Homo sapiens
  Payload ID: 18883
  Gene Name: ubiquitin specific peptidase 15
  Uniprot ID: Q9Y4E8
  ENST ID: ENST00000312635
  CDS Start-End: 19-726
taccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaaaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttagctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatatacttcctccatttaccatccttaagcttttttttctttgacagccacctacatttaaaaggctatacttaatgttgcttgccacccattcaggatttaacaaagttcttatttgtctttcttttaacctagtttatttgacctgtctttagtatttctttttgataaccatcttctaaagaaattctctgaatttgaatgcatgatacgaccttttatgccaaggactttgcctctctgaccagtcctttgtctgtctagctcggttcctctttagggttgccacatttagttttgcaaattgtgcacagctctaggaggcatcattcatatcatatgtagtctatgtgataggccctccttggcacggtgcagtgcagcttcactaactgtttgcagcagctctactcagaccttaaatgcattgacattcactaaatttctgtcagaagacctcttttatcataccatagtaggtgttcaaaattaggtgattctatgctaatcctctcccccagctcaaactgacacaaaatatgccattctgtatttctagactagaccacttttctgaattccagatttttcataaatttcatgtaggactcaccacctcaaattaaaccaaatctttttacccctccttctcccatcccctcaacctaaactgtcttcatttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagtt

SEQ ID NO: 197189 - DNA, 816 bp, Homo sapiens
  Payload ID: 18883
  Gene Name: ubiquitin specific peptidase 15
  ENST ID: ENST00000548620
  CDS Start-End: 1-150
catcagcaagccacaaagaaattggatttatggtccctgcctccagtacttgtagtacatctcaagcgattttcttacagtcgatacatgagagacaagttggataccttagttgattttcctatcaaatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttca

SEQ ID NO: 197190 - DNA, 579 bp, Homo sapiens
  Payload ID: 18883
  Gene Name: ubiquitin specific peptidase 15
  ENST ID: ENST00000548836
  CDS Start-End: 161-579
attatgcagtgcatgactgtatacagatggtcctcaacttaatgatggagttacagcctgctaaactcattagaaattgaaaatattgtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaacc

SEQ ID NO: 197191 - DNA, 533 bp, Homo sapiens
  Payload ID: 18883
  Gene Name: ubiquitin specific peptidase 15
  ENST ID: ENST00000552997
  CDS Start-End: 1-263
tagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaactttgtgggccatatggtctctgtcataactataactgctgatgtagtatgaaagcagccttagacatcatgtcaagacatggcaatgcctgtgttccaataaagctttctttaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactc

SEQ ID NO: 197192 - DNA, 584 bp, Homo sapiens
  Payload ID: 18883
  Gene Name: ubiquitin specific peptidase 15
  ENST ID: ENST00000549523
  CDS Start-End: 60-584
aatgctctggggcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaagggagggagcatacttggaatgaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaa

SEQ ID NO: 197193 - DNA, 703 bp, Homo sapiens
  Payload ID: 18883
  Gene Name: ubiquitin specific peptidase 15
  ENST ID: ENST00000549415
  CDS Start-End: 1-474
gaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtgttgggcccataacccattaaaggccagtgagtccagaagggaagtctgctggtgtacttgtgggaagtttttctggaggaaagaaaaaatgatccttctttaacagatttctgtctacatgtgattcctggaatggcacagtggcatcttgggactgggcttgaagtgtgaaggtgtgttaaccttgagtatattcttttactttagtctttatgcctgataaccaaaactgtattcatctggggtggaaaatggccttttttctacttacttttatccctaaagcccacaagctttgcattgtaatatttgaacattaaaaacaaaaaaaa

SEQ ID NO: 197194 - DNA, 791 bp, Homo sapiens
  Payload ID: 18883
  Gene Name: ubiquitin specific peptidase 15
  ENST ID: ENST00000549237
  CDS Start-End: 1-722
gagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaacacaatatcatttttatttattccaacaactttagtacttggctttgtgtgaaagaaaacagaattccctatgtaatacccaacacaccatactcatgcaataaatattggtgaatacagg

SEQ ID NO: 197195 - DNA, 799 bp, Homo sapiens
  Payload ID: 18883
  Gene Name: ubiquitin specific peptidase 15
  ENST ID: ENST00000546694
  CDS Start-End: 480-799
gtgtagactgacaaaatgtaaatgttgtgagtaagtcttaagatggactgttgaaaacattaataataatttttatggagttgaaaatgtgtatagaattaactacacaatagtgttagcatgtaagttaagataatattctctactatgttccctggtgatccccagctcctcatatccatattcttgggcactcttcttccatgttgtactgaggttggtctgtgtggccaatagcatatagcagtactcatggtacatcgctttcgagattaggttataaaaaaacaccgcggcttacatcttgggtgcacacgcactctagctgtctctctttctcatttctcactcggggaattcaactgcatatggcgaggacactcaggcagcctatggagaggcccacatggtgaggaactgagatctctggccaatagagaggaacggaggcctgcaacaaccatgtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaa

SEQ ID NO: 197196 - DNA, 3004 bp, Homo sapiens
  Payload ID: 18884
  Gene Name: ubiquitin specific peptidase 16
  Uniprot ID: Q9Y5T5
  ENST ID: ENST00000334352
  CDS Start-End: 232-2703
attgctttccaggggtcactctggcttcgactccgtcgctctcaattcgtcaccaggaggaagacggagctggctgcccagcccaaaggcccatgaggggatgcagttatgggctctgtcgccgtggaacttgtttgcttcattcttatgtacctacctttgcaccttgtaatcatcctttatgcctcagattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 197197 - DNA, 581 bp, Homo sapiens
  Payload ID: 18884
  Gene Name: ubiquitin specific peptidase 16
  ENST ID: ENST00000399973
  CDS Start-End: 259-581
tttccaggggtcactctggcttcgactccgtcgctctcaattcgtcaccaggaggaagacggagctggctgcccagcccaaaggcccatgaggggatgcagttatgggctctgtcgccgtggagatagagtgtcgctttgttgcccaggctagtcttgaacttctggcctcaagccgtcctcccacctcgatctcccaaagtgttgggattacaggcattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttag

SEQ ID NO: 197198 - DNA, 2960 bp, Homo sapiens
  Payload ID: 18884
  Gene Name: ubiquitin specific peptidase 16
  Uniprot ID: Q9Y5T5
  ENST ID: ENST00000399975
  CDS Start-End: 191-2659
ataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 197199 - DNA, 2963 bp, Homo sapiens
  Payload ID: 18884
  Gene Name: ubiquitin specific peptidase 16
  Uniprot ID: Q9Y5T5
  ENST ID: ENST00000399976
  CDS Start-End: 191-2662
ataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 197200 - DNA, 1593 bp, Homo sapiens
  Payload ID: 18885
  Gene Name: ubiquitin specific peptidase 17-like family member 1
  Uniprot ID: Q7RTZ2
  ENST ID: ENST00000529559
  CDS Start-End: 1-1593
atgggggacgactcactctacttgggaggtgagtggcagttcaaccacttttcaaaactcacatcttctcggccagatgcagcttttgctgaaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggctgctggcttccatagaggcaagcaggaagatgtccatgaatttctcatgttcactgtggatgccatgaaaaaggcatgccttcccggccacaagcaggtagatcatcactgcaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctccgatgtcgcaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggacattacttctcctatgtcaaagctcaagaagtccagtggtataaaatggatgatgccgaggtcactgtctgtagcatcatttctgtcctgagtcaacaggcctatgtcctcttttacatccagaagagtgaatgggaaagacacagtgagagtgtgtcaagaggcagggaaccaagagccctcggcgctgaagacacagacaggcgagcaaagcaaggagagctcaagagagaccacccctgcctccaggcacccgagttggacgagcacttggtggaaagagccactcaggaaagcaccttagaccactggaaattcctgcaagagcaaaacaaaacgaagcctgagttcaacgtcggaaaagtcgaaggtaccctgcctcccaacgcacttgtgattcatcaatcaaaatacaagtgtgggatgaaaaaccatcatcctgaacagcaaagctccctgctaaacctctcttcgacgacccggacagatcaggagtccatgaacactggcacactcgcttctctgcaagggaggaccaggagagccaaagggaagaacaaacacagcaagagggctctgcttgtgtgccagtga

SEQ ID NO: 197201 - DNA, 1677 bp, Homo sapiens
  Payload ID: 18886
  Gene Name: ubiquitin specific peptidase 17-like family member 10
  ENST ID: ENST00000421288
  CDS Start-End: 1-1677
atggaggacgactcactctacttgggaggtgagtggcagttcaaccacttttcaaaactcacatcttctcggccagatgcagcttttgctgaaatccagcgtacttctctccctgagaagtcaccactctcatgtgagacccgtgtcgacctctgtgatgatttggctcctgtggcaagacagcttgctcccagggagaagcctcctctgagtagcaggagacctgctgcggtgggggctgggctccagaatatgggaaatacctgctacgtgaacgcttccctgcagtgcctgacatacaaaccgccacttgccaactacatgctgttccgggagcactctcaaacgtgtcatcgtcacaagggctgcatgctctgtactatgcaagctcacatcacaagggccctccacattcctggccatgtcatccagccctcacaggcattggctgctggcttccatagaggcaagcaggaagatgcccatgaatttctcatgttcactgtggatgccatgagaaaggcatgccttcccgggcacaagcaggtagatcgtcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacaactctgccaaggtcctcatccttgtattgaagagattccccgatgtcacaggcaacaaaattgccaagaatgtgcaatatcctgagtgccttgacatgcagccatacatgtctcagcagaacacaggacctctcgtctatgtcctctatgctgtgctggtccacgctgggtggagttgtcacaacggacattactcctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgtagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaagagtcgaaggtacggtgcctcccgacgtacttgtgattcatcaatcaaaatacaagtgtcggatgaagaaccatcatcctgaacagcaaagctccctgctaaacctctcttcgacgaccccgacagatcaggagtccatgaacactggcacactcgcttccctacgagggaggaccaggagatccaaagggaagaacaaacacagcaagagggctctgcttgtgtgccagtctcagtggaagtaccgacccacacgtgacattcagtgtgtatttatgaatatgacctaccgacgtgtaggtttgcgtgtgaggtaa

SEQ ID NO: 197202 - DNA, 1593 bp, Homo sapiens
  Payload ID: 18886
  Gene Name: ubiquitin specific peptidase 17-like family member 10
  Uniprot ID: C9JJH3
  ENST ID: ENST00000417945
  CDS Start-End: 1-1593
atggaggacgactcactctacttgggaggtgagtggcagttcaaccacttttcaaaactcacatcttctcggccagatgcagcttttgctgaaatccagcgtacttctctccctgagaagtcaccactctcatgtgagacccgtgtcgacctctgtgatgatttggctcctgtggcaagacagcttgctcccagggagaagcctcctctgagtagcaggagacctgctgcggtgggggctgggctccagaatatgggaaatacctgctacgtgaacgcttccctgcagtgcctgacatacaaaccgccacttgccaactacatgctgttccgggagcactctcaaacgtgtcatcgtcacaagggctgcatgctctgtactatgcaagctcacatcacaagggccctccacattcctggccatgtcatccagccctcacaggcattggctgctggcttccatagaggcaagcaggaagatgcccatgaatttctcatgttcactgtggatgccatgagaaaggcatgccttcccgggcacaagcaggtagatcgtcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacaactctgccaaggtcctcatccttgtattgaagagattccccgatgtcacaggcaacaaaattgccaagaatgtgcaatatcctgagtgccttgacatgcagccatacatgtctcagcagaacacaggacctctcgtctatgtcctctatgctgtgctggtccacgctgggtggagttgtcacaacggacattactcctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgtagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaagagtcgaaggtacggtgcctcccgacgtacttgtgattcatcaatcaaaatacaagtgtcggatgaagaaccatcatcctgaacagcaaagctccctgctaaacctctcttcgacgaccccgacagatcaggagtccatgaacactggcacactcgcttccctacgagggaggaccaggagatccaaagggaagaacaaacacagcaagagggctctgcttgtgtgccagtga

SEQ ID NO: 197203 - DNA, 1593 bp, Homo sapiens
  Payload ID: 18887
  Gene Name: ubiquitin specific peptidase 17-like family member 11
  Uniprot ID: C9JVI0
  ENST ID: ENST00000457736
  CDS Start-End: 1-1593
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagacgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccagtga

SEQ ID NO: 197204 - DNA, 1677 bp, Homo sapiens
  Payload ID: 18887
  Gene Name: ubiquitin specific peptidase 17-like family member 11
  ENST ID: ENST00000613973
  CDS Start-End: 1-1677
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagacgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197205 - DNA, 1593 bp, Homo sapiens
  Payload ID: 18888
  Gene Name: ubiquitin specific peptidase 17-like family member 12
  Uniprot ID: C9JPN9
  ENST ID: ENST00000415041
  CDS Start-End: 1-1593
atggaggaagactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtaacaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagatgttaactttactcacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaaactctcttcgacgaccccgacacatcaggagtccatgaacactggcacactcgcttccctgcgagggagggccaggagatccaaagggaagaacaaacacagcaagagggctctgcttgtgtgccagtga

SEQ ID NO: 197206 - DNA, 1593 bp, Homo sapiens
  Payload ID: 18889
  Gene Name: ubiquitin specific peptidase 17-like family member 13
  Uniprot ID: C9JLJ4
  ENST ID: ENST00000429667
  CDS Start-End: 1-1593
atggaggaggactcactctacttgggtggtgagtggcagttcaaccacttttcaaaactcacatcttctcggctcgatgcagcttttgctgaaatccagcggacttctctccctgagaagtcaccactctcatgtgagacccgtgtcgacctctgtgatgatttggttcctgaggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtactatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatccctctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtgacaggcaacaagattgccaagaatgtgcaatatcctgagtgccttgacatgcagccatacatgtctcagcagaacacaggacctcttgtctatgtcctctatgctgtgctggtccacgctgggtggagttgtcacaacggacattacttctcttatgtcaaagctcaagaaggccaatggtataaaatggatgatgccgaggtcaccgccgctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccgctggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtga

SEQ ID NO: 197207 - DNA, 1677 bp, Homo sapiens
  Payload ID: 18889
  Gene Name: ubiquitin specific peptidase 17-like family member 13
  ENST ID: ENST00000616303
  CDS Start-End: 1-1677
atggaggaggactcactctacttgggtggtgagtggcagttcaaccacttttcaaaactcacatcttctcggctcgatgcagcttttgctgaaatccagcggacttctctccctgagaagtcaccactctcatgtgagacccgtgtcgacctctgtgatgatttggttcctgaggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtactatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatccctctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtgacaggcaacaagattgccaagaatgtgcaatatcctgagtgccttgacatgcagccatacatgtctcagcagaacacaggacctcttgtctatgtcctctatgctgtgctggtccacgctgggtggagttgtcacaacggacattacttctcttatgtcaaagctcaagaaggccaatggtataaaatggatgatgccgaggtcaccgccgctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccgctggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197208 - DNA, 1590 bp, Homo sapiens
  Payload ID: 18890
  Gene Name: ubiquitin specific peptidase 17-like family member 15
  Uniprot ID: C9J2P7
  ENST ID: ENST00000456464
  CDS Start-End: 1-1590
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgacaagaatgtgcaatatcctgagtgccttgacatgaagctatacatgtctcagacgaactcaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccag

SEQ ID NO: 197209 - DNA, 1680 bp, Homo sapiens
  Payload ID: 18890
  Gene Name: ubiquitin specific peptidase 17-like family member 15
  ENST ID: ENST00000614248
  CDS Start-End: 1-1680
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgacaagaatgtgcaatatcctgagtgccttgacatgaagctatacatgtctcagacgaactcaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccagtggtctcagtggaagtaccgacccacacgtgacattcagtgtgtatttctgaatatgacctaccgacgtgtaggtttgcgtgtgaggtaa

SEQ ID NO: 197210 - DNA, 1680 bp, Homo sapiens; identical to SEQ ID NO: 197209
  Payload ID: 18890
  Gene Name: ubiquitin specific peptidase 17-like family member 15
  ENST ID: ENST00000621432
  CDS Start-End: 1-1680

SEQ ID NO: 197211 - DNA, 1593 bp, Homo sapiens
  Payload ID: 18891
  Gene Name: ubiquitin specific peptidase 17-like family member 17
  Uniprot ID: D6RBQ6
  ENST ID: ENST00000511568
  CDS Start-End: 1-1593
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtgacaggcaacaagattgccaagaatgtgcaatatcctgagtgccttgacatgcagccatacatgtctcagcagaacacaggacctcttgtctatgtcctctatgctgtgctggtccacgctgggtggagttgtcacaacggacattacttctcttatgtcaaagctcaagaaggccaatggtataaaatggatgatgccgaggtcaccgccgctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtga

SEQ ID NO: 197212 - DNA, 1677 bp, Homo sapiens
  Payload ID: 18891
  Gene Name: ubiquitin specific peptidase 17-like family member 17
  ENST ID: ENST00000614762
  CDS Start-End: 1-1677
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtgacaggcaacaagattgccaagaatgtgcaatatcctgagtgccttgacatgcagccatacatgtctcagcagaacacaggacctcttgtctatgtcctctatgctgtgctggtccacgctgggtggagttgtcacaacggacattacttctcttatgtcaaagctcaagaaggccaatggtataaaatggatgatgccgaggtcaccgccgctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197213 - DNA, 1593 bp, Homo sapiens
  Payload ID: 18892
  Gene Name: ubiquitin specific peptidase 17-like family member 18
  Uniprot ID: D6R9N7
  ENST ID: ENST00000504209
  CDS Start-End: 1-1593
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgtatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagacgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaaagcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccagtga

SEQ ID NO: 197214 - DNA, 1677 bp, Homo sapiens
  Payload ID: 18892
  Gene Name: ubiquitin specific peptidase 17-like family member 18
  ENST ID: ENST00000619296
  CDS Start-End: 1-1677
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgtatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagacgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacacagacaggcgagcaaagcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197215 - DNA, 1593 bp, Homo sapiens
  Payload ID: 18893
  Gene Name: ubiquitin specific peptidase 17-like family member 19
  Uniprot ID: D6RCP7
  ENST ID: ENST00000515566
  CDS Start-End: 1-1593
atggaggaagactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgtatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagacgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaaactctcttcgacgaccccgacacatcaggagtccatgaacactggcacactcgcttccctgcgagggagggccaggagatccaaagggaagaacaaacacagcaagagggctctgcttgtgtgccagtga

SEQ ID NO: 197216 - DNA, 1677 bp, Homo sapiens
  Payload ID: 18893
  Gene Name: ubiquitin specific peptidase 17-like family member 19
  ENST ID: ENST00000615989
  CDS Start-End: 1-1677
atggaggaagactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgtatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagacgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaaactctcttcgacgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgcgtaggtttgcgtgtgaggtaa

SEQ ID NO: 197217 - DNA, 1910 bp, Homo sapiens
  Payload ID: 18894
  Gene Name: ubiquitin specific peptidase 17-like family member 2
  Uniprot ID: Q6R6M4
  ENST ID: ENST00000333796
  CDS Start-End: 318-1910
tattatatgtgcctatcaccctgaggagtaatttgattcaggtgttctagaagtcatgatgtgggctgtgtctgttgaattcccagcgatgcaaggggacacaccctgtgactcattccttaattgagtgctgatatttgattggtttatcgcacacctgatgggtgggtggggtgttcgcggttggtgggggtgagttatataagggctgatgcggccagagagctcgtcatttgaagactctcttggaagagatagcgtcttgctgcaacctgcagtcccagcagaaaaaccttgtgatccttgttgcgggcgacatggaggacgactcactctacttgggaggtgagtggcagttcaaccacttttcaaaactcacatcttctcggccagatgcagcttttgctgaaatccagcggacttctctccctgagaagtcaccactctcatctgaggcccgtgtcgacctctgtgatgatttggctcctgtggcaagacagcttgctcccaggaagaagcttcctctgagtagcaggagacctgctgcggtgggggctgggctccagaatatgggaaatacctgctacgagaacgcttccctgcagtgcctgacatacacaccgccccttgccaactacatgctgtcccgggagcactctcaaacatgtcagcgtcccaagtgctgcatgctctgtactatgcaagctcacatcacatgggccctccacagtcctggtcatgtcatccagccctcacaggcattggctgctggcttccatagaggcaagcaggaagatgcccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaagacgttaactttacacacttctgccaaggtcctcatccttgtcttgaagagattctccgatgtcacaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggacattacttctcttatgtcaaagctcaagaaggccagtggtataaaatggatgatgccaaggtcactgcctgtagcatcacttctgtcctgagtcaacaggcctatgtcctcttttacatccagaagagtgaatgggaaagacacagtgagagtgtgtcaagaggcagggaaccaagagccctcggcgctgaagacacagacaggcgagcaacgcaaggagagctcaagagagaccacccctgcctccaggcacccgagttggacgagcgcttggtggaaagagccactcaggaaagcaccttagaccactggaaattcccccaagagcaaaacaaaacgaagcctgagttcaacgtcagaaaagtcgaaggtaccctgcctcccaacgtacttgtgattcatcaatcgaaatacaagtgtgggatgaaaaaccatcatcctgaacagcaaagctccctgctaaacctctcttcgacgacccggacagatcaggagtccgtgaacactggcaccctcgcttctctgcaagggaggaccaggagatccaaagggaagaacaaacacagcaagagggctctgcttgtgtgccagtga

SEQ ID NO: 197218 - DNA, 1593 bp, Homo sapiens
  Payload ID: 18895
  Gene Name: ubiquitin specific peptidase 17-like family member 20
  Uniprot ID: D6RJB6
  ENST ID: ENST00000506151
  CDS Start-End: 1-1593
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccagtga

SEQ ID NO: 197219 - DNA, 1677 bp, Homo sapiens
  Payload ID: 18895
  Gene Name: ubiquitin specific peptidase 17-like family member 20
  ENST ID: ENST00000613757
  CDS Start-End: 1-1677
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197220 - DNA, 1593 bp, Homo sapiens
  Payload ID: 18896
  Gene Name: ubiquitin specific peptidase 17-like family member 21
  Uniprot ID: D6R901
  ENST ID: ENST00000506414
  CDS Start-End: 1-1593
atggaggaagactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtaacaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagatgttaactttactcacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtga

SEQ ID NO: 197221 - DNA, 1677 bp, Homo sapiens
  Payload ID: 18896
  Gene Name: ubiquitin specific peptidase 17-like family member 21
  ENST ID: ENST00000621388
  CDS Start-End: 1-1677
atggaggaagactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtaacaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagatgttaactttactcacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197222 - DNA, 1593 bp, Homo sapiens
  Payload ID: 18897
  Gene Name: ubiquitin specific peptidase 17-like family member 22
  Uniprot ID: D6RA61
  ENST ID: ENST00000511280
  CDS Start-End: 1-1593
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagcagaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaaactctcttcgacgaccccgacacatcaggagtccatgaacactggcacactcgcttccctgcgagggagggccaggagatccaaagggaagaacaaacacagcaagagggctctgcttgtgtgccagtga

SEQ ID NO: 197223 - DNA, 1677 bp, Homo sapiens
  Payload ID: 18897
  Gene Name: ubiquitin specific peptidase 17-like family member 22
  ENST ID: ENST00000622009
  CDS Start-End: 1-1677
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtggatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagcagaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagagaaccaagagcccttggcgcagaagacacagacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaaactctcttcgacgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197224 - DNA, 551 bp, Homo sapiens
  Payload ID: 18898
  Gene Name: ubiquitin specific peptidase 17-like family member 23
  Uniprot ID: D6RBM5
  ENST ID: ENST00000506619
  CDS Start-End: 1-551
atggaggacgactcactctacttgggaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtacgatgcaagctcacatcacacgggccctccacaatcctggccacgtcatccagccctcacaggcattggctgctggcttccatagaggcaagcaggaagatgcccatgaatttctcatgttcactgtggatgccatggaaaaggcatgccttcccgggcacaagcaggtaga

SEQ ID NO: 197225 - DNA, 1593 bp, Homo sapiens
  Payload ID: 18899
  Gene Name: ubiquitin specific peptidase 17-like family member 24
  Uniprot ID: Q0WX57
  ENST ID: ENST00000504481
  CDS Start-End: 1-1593
atggaggacgactcactctacttgagaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtactatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacaccgacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtga

SEQ ID NO: 197226 - DNA, 1677 bp, Homo sapiens
  Payload ID: 18899
  Gene Name: ubiquitin specific peptidase 17-like family member 24
  ENST ID: ENST00000622713
  CDS Start-End: 1-1677
atggaggacgactcactctacttgagaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtactatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacaccgacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtctcagtggaagtaccgacccacacgtgacattcagtgtgtatttctgaatatgacctaccgacgtgtaggtttgcgtgtgaggtaa

SEQ ID NO: 197227 - DNA, 1593 bp, Homo sapiens; identical to SEQ ID NO: 197225
  Payload ID: 18900
  Gene Name: ubiquitin specific peptidase 17-like family member 25
  Uniprot ID: Q0WX57
  ENST ID: ENST00000509271
  CDS Start-End: 1-1593

SEQ ID NO: 197228 - DNA, 1677 bp, Homo sapiens; identical to SEQ ID NO: 197226
  Payload ID: 18900
  Gene Name: ubiquitin specific peptidase 17-like family member 25
  ENST ID: ENST00000621472
  CDS Start-End: 1-1677

SEQ ID NO: 197229 - DNA, 1593 bp, Homo sapiens; identical to SEQ ID NO: 197225
  Payload ID: 18901
  Gene Name: ubiquitin specific peptidase 17-like family member 26
  Uniprot ID: Q0WX57
  ENST ID: ENST00000509660
  CDS Start-End: 1-1593

SEQ ID NO: 197230 - DNA, 1677 bp, Homo sapiens; identical to SEQ ID NO: 197226
  Payload ID: 18901
  Gene Name: ubiquitin specific peptidase 17-like family member 26
  ENST ID: ENST00000610514
  CDS Start-End: 1-1677

SEQ ID NO: 197231 - DNA, 1593 bp, Homo sapiens; identical to SEQ ID NO: 197225
  Payload ID: 18902
  Gene Name: ubiquitin specific peptidase 17-like family member 27
  Uniprot ID: Q0WX57
  ENST ID: ENST00000515574
  CDS Start-End: 1-1593

SEQ ID NO: 197232 - DNA, 1593 bp, Homo sapiens; identical to SEQ ID NO: 197225
  Payload ID: 18903
  Gene Name: ubiquitin specific peptidase 17-like family member 28
  Uniprot ID: Q0WX57
  ENST ID: ENST00000504543
  CDS Start-End: 1-1593

SEQ ID NO: 197233 - DNA, 1593 bp, Homo sapiens; identical to SEQ ID NO: 197225
  Payload ID: 18904
  Gene Name: ubiquitin specific peptidase 17-like family member 29
  Uniprot ID: Q0WX57
  ENST ID: ENST00000511681
  CDS Start-End: 1-1593

SEQ ID NO: 197234 - DNA, 1593 bp, Homo sapiens
  Payload ID: 18905
  Gene Name: ubiquitin specific peptidase 17-like family member 3
  Uniprot ID: A6NCW0
  ENST ID: ENST00000530484
  CDS Start-End: 1-1593
atgggggatgactcactctacttgggaggtgagtggcagttcaaccacttttcaaaactcacatcttctcggccagatgcagcttttgctgaaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggcttctggcttccatagaggcaagcaggaagatgtccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctccgatgtcgcaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggacattacttctcttatgtcaaagctcaagaaggccagtggtataaaatggatgatgccgaggtcactgtctgtagcatcacttctgtcctgagtcaacaggcctatgtcctcttttacatccagaagagtgaatgggaaagacacagtgagagtgtgtcaagaggcagggaaccaagagccctcggcgctgaagacacagacaggcgagcaaagcaaggagagctcaagagagaccacccctgcctccaggcacccgagttggacgagcacttggtggaaagagccactcaggaaagcaccttagaccactggaaattcctccaagagcaaaacaaaacgaagcctgagttcaacgtcggaaaagtcgaaggtaccctgcctcccaacgcacttgtgattcatcaatcaaaatacaagtgtgggatgaaaaaccatcatcctgaacagcaaagctccctgctaaacctctcttcgacgacccggacagatcaggagtccatgaacactggcacactcgcttctctgcaagggaggaccaggagagccaaagggaagaacaaacacagcaagagggctctgcttgtgtgccagtga

SEQ ID NO: 197235 - DNA, 1593 bp, Homo sapiens; identical to SEQ ID NO: 197225
  Payload ID: 18906
  Gene Name: ubiquitin specific peptidase 17-like family member 30
  Uniprot ID: Q0WX57
  ENST ID: ENST00000504104
  CDS Start-End: 1-1593

SEQ ID NO: 197236 - DNA, 1593 bp, Homo sapiens
  Payload ID: 18907
  Gene Name: ubiquitin specific peptidase 17-like family member 4
  Uniprot ID: A6NCW7
  ENST ID: ENST00000526929
  CDS Start-End: 1-1593
atgggggacgactcactctacttgggaggtgagtggcagttcaaccacttttcaaaactcacatcttctcggccagatgcagcttttgctgaaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggctgctggcttccatagaggcaagcaggaagatgtccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctccgatgtcgcaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggatattacttctcttatgtcaaagctcaagaaggccagtggtataaaatggatgatgccgaggtcactgtctgtagcatcacttctgtcctgagtcaacaggcctatgtcctcttttacatccagaagagtgaatgggaaagacacagtgagagtgtgtcaagaggcagggaaccaagagcccttggcgctgaagacacagacaggccagcaacgcaaggagagctcaagagagaccacccttgcctccaggtacccgagttggacgagcacttggtggaaagagccactgaggaaagcaccttagaccactggaaattcccccaagagcaaaacaaaatgaagcctgagttcaacgtcagaaaagttgaaggtaccctgcctcccaacgtacttgtgattcatcaatcaaaatacaagtgtgggatgaaaaaccaccatcctgaacagcaaagctccctgctaaacctctcttcgatgaactcgacagatcaggagtccatgaacactggcacactcgcttctctgcaagggaggaccaggagatccaaagggaagaacaaacacagcaagagatctctgcttgtgtgccagtga

SEQ ID NO: 197237 - DNA, 1593 bp, Homo sapiens
  Payload ID: 18908
  Gene Name: ubiquitin specific peptidase 17-like family member 5
  Uniprot ID: A8MUK1
  ENST ID: ENST00000507227
  CDS Start-End: 1-1593
atggaggacgactcactctacttgagaggtgagtggcagttcaaccacttttcaaaactcacatcttctcggcccgatgcagcttttgctgaaatccagcggacttctctccctgagaagtcaccactctcatgtgagacccgtgtcgacctctgtgatgatttggctcctgtggcaagacagcttgctcccagggagaagcttcctctgagtagcaggagacctgctgcggtgggggctgggctccagaatatgggaaatacctgctacgtgaacgcttccttgcagtgcctgacatacacaccgccccttgccaactacatgctgtcccgggagcactctcaaacgtgtcatcgtcacaagggctgcatgctctgtactatgcaagctcacatcacacgggccctccacaatcctggccacgtcatccagccctcacaggcattggctgctggcttccatagaggcaagcaggaagatgcccatgaatttctcatgttcactgtggatgccatgaaaaaggcatgccttcccgggcacaagcaggtagatcatcactctaaggacaccaccctcatccaccaaatatttggaggctactggagatctcaaatcaagtgtctccactgccacggcatttcagacacttttgacccttacctggacatcgccctggatatccaggcagctcagagtgtccagcaagctttggaacagttggcgaagcccgaagaactcaatggagagaatgcctatcattgtggtgtttgtctccagagggcgccggcctccaagacgttaactttacacacctctgccaaggtcctcatccttgtattgaagagattctccgatgtcacaggcaacaagattgccaagaatgtgcaatatcctgagtgccttgacatgcagccatacatgtctcagccgaacacaggacctctcgtctatgtcctctatgctgtgctggtccacgctgggtggagttgtcacaacggacattacttctcttatgtcaaagctcaagaaggccagtggtataaaatggatgatgccgaggtcaccgcctctagcatcacttctgtcctgagtcaacaggcctacgtcctcttttacatccagaagagtgaatgggaaagacacagtgagagtgtgtcaagaggcagggaaccaagagcccttggcgcagaagacaccgacaggcgagcaacgcaaggagagctcaagagagaccacccctgcctccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgtcgaccccgacacatcaggagtccatgaacactggcacactcgcttccctgcgagggagggccaggagatccaaagggaagaacaaacacagcaagagggctctgcttgtgtgccagtga

SEQ ID NO: 197238 - DNA, 2028 bp, Homo sapiens
  Payload ID: 18909
  Gene Name: ubiquitin specific peptidase 17-like family member 7
  Uniprot ID: P0C7H9
  ENST ID: ENST00000530447
  CDS Start-End: 436-2028
acacacacacacacacacagacacacacacggtttcataggtaaagatttcttccctgacattcttttacctaaaataaggcaactgtgtggccactgtcccaacccggttacactcatattacatgtgtctatcagcctgaggagtaatttgattcaggtgttctagaagtcatgatgtgggctgtgtctgttgaattcccagcgatgcaaggggacacaccctgtgactcattccttaattgagtgctgatatttgattggtttatcgcacacctgatgggtgggtggggtgttcgcggttggagggggtgagttatataagggctgatgcggccagagagctggtcatttgaagactctctcggaagagatagcgtcttgctgcaacctgcggtcccagcagaaaaaccttgtgatccttgttgcgggcgacatggaagacgactcactctatttgggaggtgactggcagttcaatcacttttcaaaactcacatcttctcggctagatgcagcttttgctgaaatccagcggacttctctctctgaaaagtcaccactctcatctgagacccgtttcgacctctgtgatgatttggctcctgtggcaagacagcttgctcccagggagaagcttcctctgagtagcaggagacctgctgcggtgggggctgggctccagaagataggaaataccttctatgtgaacgtttccctgcagtgcctgacatacacactgccgctttccaactacatgctgtcccgggaggactctcaaacgtgtcatcttcacaagtgctgcatgttctgtactatgcaagctcacatcacatgggccctccacagtcctggccatgtcatccagccctcacaggtattggctgctggcttccatagaggtgagcaggaggatgcccatgaatttctcatgtttactgtggatgccatgaaaaaggcatgccttcccgggcacaagcagctagatcatcactccaaggacaccaccctcatccaccaaatatttggagcgtattggagatctcaaatcaagtatctccactgccacggcgtttcagacacctttgacccttacctggacatcgccctggatatccaggcagctcagagtgtcaagcaagctttggaacagttggtgaagcccaaagaactcaatggagagaatgcctatcattgtggtctttgtctccagaaggcgcctgcctccaagacgttaactttacccacttctgccaaggtcctcattcttgtattgaagagattctccgatgtcacaggcaacaaacttgccaagaatgtgcaatatcctaagtgccgtgacatgcagccatacatgtctcagcagaacacaggacctcttgtctatgtcctctatgctgtgctggtccacgctgggtggagttgtcacaacggacattacttctcttatgtcaaagctcaagaaggccagtggtataaaatggatgatgccgaggtcactgcctctggcatcacctctgtcctgagtcaacaggcctatgtcctcttttacatccagaagagtgaatgggaaagacacagtgagagtgtgtcaagaggcagggaaccaagagcccttggtgctgaagacacagacaggccagcaacgcaaggagagctcaagagagaccacccttgcctccaggtacccgagttggacgagcacttggtggaaagagccactcaggaaagcaccttagaccactggaaattcccccaagagcaaaacaaaacgaagcctgagttcaacgtcagaaaagttgaaggtaccctgcctcccaacgtacttgtgattcatcaatcaaaatacaagtgtggtatgaaaaaccatcatcctgaacagcaaagctccctgctaaacctctcttcgacgaaaccgacagatcaggagtccatgaacactggcacactcgcttctctgcaagggagcaccaggagatccaaagggaataacaaacacagcaagagatctctgcttgtgtgccagtga

SEQ ID NO: 197239 - DNA, 1593 bp, Homo sapiens
  Payload ID: 18910
  Gene Name: ubiquitin specific peptidase 17-like family member 8
  ENST ID: ENST00000625190
  CDS Start-End: 1-1593
atgggggatgactcactctacttgggaggtgagtggcagttcaaccacttttcaaaactcacatcttctcggccagatgcagcttttgctgaaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggcttctggcttccatagaggcaagcaggaagatgtccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctgcgatgtcacaggcaacaaacttgccaagaatgtgcaatatcctgagtgccttgacatgcagccatacatgtctcagcagaacacaggacctcttgtctatgtcctctatgctgtgctggtccacgctgggtggagttgtcacaacggatattacttctcttatgtcaaagctcaagaaggccagtggtataaaatggatgatgccgaggtcactgcctgtagcatcacttctgtcctgagtcaacaggcctatgtcctcttttacatccagaagagtgaatgggaaagacacagtgagagtgtgtcaagaggcagggaaccaagagcccttggcgctgaagacacagacaggccagcaacgcaaggagagctcaagagagaccacccttgcctccaggtacccgagttggacgagcacttggtggaaagagccactgaggaaagcaccttagaccactggaaattcccccaagagcaaaacaaaatgaagcctgagttcaacgtcagaaaagttgaaggtaccctgcctcccaacgtacttgtgattcatcaatcaaaatacaagtgtgggatgaaaaaccaccatcctgaacagcaaagctccctgctaaacctctcttcgatgaactcgacagatcaggagtccatgaacactggcacactcgcttctctgcaagggaggaccaggagatccaaagggaagaacaaacacagcaagagatctctgcttgtgtgccagtga

SEQ ID NO: 197240 - DNA, 1593 bp, Homo sapiens
  Payload ID: 18910
  Gene Name: ubiquitin specific peptidase 17-like family member 8
  Uniprot ID: P0C7I0
  ENST ID: ENST00000527080
  CDS Start-End: 1-1593
atggaggacgactcactctacttgggaggtgagtggcagttcaaccacttttcaaaactcacatctcctcggccagatgcagcttttgctgaaatccagcggacttctctccctgagaagtcaccactctcatctgagacccgtgtcgacctctgtgatgatttggctcctgtggcaagacagcttgctcccagggagaagcttcctctgagtagcaggagacctgctgctgtgggggctggtctccagaatatgggaaatacctgctacttgaatgcttccctgcagtgcctgacatacacaccgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggctgctggcttccatagaggcaagcaggaagatgcccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatccttgcggtctttgtctccagagggcgccggcctccaacacgttaactttacacacttctgccaaggtcctcatccttgtcttgaagagattctgcgatgtcacaggcaacaaacttgccaagaatgtgcaatatcctgagtgccttgacatgcagccatacatgtctcagcagaacacaggacctcttgtctatgtcctctatgctgtgctggtccacgctgggtggagttgtcacaacggatattacttctcttatgtcaaagctcaagaaggccagtggtataaaatggatgatgccgaggtcactgcctgtagcatcacttctgtcctgagtcaacaggcctatgtcctcttttacatccagaagagtgaatgggaaagacacagtgagagtgtgtcaagaggcagggaaccaagagcccttggcgctgaagacacagacaggccagcaacgcaaggagagctcaagagagaccacccttgcctccaggtacccgagttggacgagcacttggtggaaagagccactgaggaaagcaccttagaccactggaaattcccccaagagcaaaacaaaatgaagcctgagttcaacgtcagaaaagttgaaggtaccctgcctcccaacgtacttgtgattcatcaatcaaaatacaagtgtgggatgaaaaaccaccatcctgaacagcaaagctccctgctaaacctctcttcgatgaactcgacagatcaggagtccatgaacactggcacactcgcttctctgcaagggaggaccaggagatccaaagggaagaacaaacacagcaagagatctctgcttgtgtgccagtga

SEQ ID NO: 197241 - DNA, 2129 bp, Homo sapiens
  Payload ID: 18911
  Gene Name: ubiquitin specific peptidase 18
  Uniprot ID: Q9UMW8
  ENST ID: ENST00000215794
  CDS Start-End: 431-1549
gacagaatgagactccgtctcaaaaaaaaaaaaaaaaaaaaaaagcgagggctggaagtctggagcaggtgcgcggctgcaacggcagccgcgggaagctcgggccggcagggtttccccgcacgctggcgcccagctcccggcgcggaggccgctgtaagtttcgctttccattcagtggaaaacgaaagctgggcggggtgccacgagcgcggggccagaccaaggcgggcccggagcggaacttcggtcccagctcggtccccggctcagtcccgacgtggaactcagcagcggaggctggacgcttgcatggcgcttgagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggcctggttggtttacacaacattggacagacctgctgccttaactccttgattcaggtgttcgtaatgaatgtggacttcaccaggatattgaagaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgcccttgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaa

SEQ ID NO: 197242 - DNA, 1905 bp, Homo sapiens
  Payload ID: 18912
  Gene Name: ubiquitin specific peptidase 19
  ENST ID: ENST00000306026
  CDS Start-End: 200-1905
ggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgt

SEQ ID NO: 197243 - DNA, 4559 bp, Homo sapiens
  Payload ID: 18912
  Gene Name: ubiquitin specific peptidase 19
  Uniprot ID: O94966
  ENST ID: ENST00000398888
  CDS Start-End: 320-4276
agcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggccc

SEQ ID NO: 197244 - DNA, 4622 bp, Homo sapiens
  Payload ID: 18912
  Gene Name: ubiquitin specific peptidase 19
  ENST ID: ENST00000398892
  CDS Start-End: 261-4337
ggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaa

SEQ ID NO: 197245 - DNA, 3907 bp, Homo sapiens
  Payload ID: 18912
  Gene Name: ubiquitin specific peptidase 19
  ENST ID: ENST00000398896
  CDS Start-End: 1-3541
atccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtagactta

SEQ ID NO: 197246 - DNA, 4474 bp, Homo sapiens
  Payload ID: 18912
  Gene Name: ubiquitin specific peptidase 19
  ENST ID: ENST00000398898
  CDS Start-End: 143-4108
cattaggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtagactta

SEQ ID NO: 197247 - DNA, 4706 bp, Homo sapiens
  Payload ID: 18912
  Gene Name: ubiquitin specific peptidase 19
  Uniprot ID: O94966
  ENST ID: ENST00000417901
  CDS Start-End: 190-4344
cggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtaga

SEQ ID NO: 197248 - DNA, 4719 bp, Homo sapiens
  Payload ID: 18912
  Gene Name: ubiquitin specific peptidase 19
  Uniprot ID: O94966
  ENST ID: ENST00000453664
  CDS Start-End: 320-4438
agcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattct

SEQ ID NO: 197249 - DNA, 4677 bp, Homo sapiens
  Payload ID: 18912
  Gene Name: ubiquitin specific peptidase 19
  Uniprot ID: O94966
  ENST ID: ENST00000434032
  CDS Start-End: 213-4472
accgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctga

SEQ ID NO: 197250 - DNA, 360 bp, Homo sapiens
  Payload ID: 18912
  Gene Name: ubiquitin specific peptidase 19
  ENST ID: ENST00000479073
  CDS Start-End: 1-360
aaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttg

SEQ ID NO: 197251 - DNA, 3732 bp, Homo sapiens
  Payload ID: 18913
  Gene Name: ubiquitin specific peptidase 2
  Uniprot ID: O75604
  ENST ID: ENST00000260187
  CDS Start-End: 296-2113
agtgacgcgagacgcggggtgtggctctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatactccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccgtcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcatagctgggacgttgcactggtccttttattgcttttccaagtacaactttctaatgctagccctccgtggtgctaggtgggcgttggccaggccccaagcacagccacagtagacctgggatctaaaacaagtttctgttttgggggtttgggttttttttttttttttttaatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatc

SEQ ID NO: 197252 - DNA, 2903 bp, Homo sapiens
  Payload ID: 18913
  Gene Name: ubiquitin specific peptidase 2
  Uniprot ID: O75604
  ENST ID: ENST00000455332
  CDS Start-End: 195-1283
ggggtgtggctctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatactccaagaagaggcagaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcatagctgggacgttgcactggtccttttattgcttttccaagtacaactttctaatgctagccctccgtggtgctaggtgggcgttggccaggccccaagcacagccacagtagacctgggatctaaaacaagtttctgttttgggggtttgggttttttttttttttttttaatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatca

SEQ ID NO: 197253 - DNA, 563 bp, Homo sapiens
  Payload ID: 18913
  Gene Name: ubiquitin specific peptidase 2
  ENST ID: ENST00000527843
  CDS Start-End: 151-563
ggattacccagcccagagtcaggctccagcttctgggctttccactgcattccctgccctgctggggaaggagaagcccccagctcccatccagtgcccctggacacagcccatgaggctcccagtccccactgagtgccaccctgaaggatgtcccagctctcctccaccctgaagcgctacacagaatcggcccgctacacagatgcccactatgccaagtcgggctatggtgcctacaccccgtcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaaccca

SEQ ID NO: 197254 - DNA, 677 bp, Homo sapiens
  Payload ID: 18913
  Gene Name: ubiquitin specific peptidase 2
  ENST ID: ENST00000531070
  CDS Start-End: 175-677
gtggcaacagggagactcgcagccacgtgagtgcccgtcctgtccctgtcttgcgcagcgagactccggccagggccccagcccgctctcctgcccatagtgcattctgtggcctccagggacagctgtgcagcccatgaggctcccagtccccactgagtgccaccctgaaggatgtcccagctctcctccaccctgaagcgctacacagaatcggcccgctacacagatgcccactatgccaagtcgggctatggtgcctacaccccgtcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccg

SEQ ID NO: 197255 - DNA, 1704 bp, Homo sapiens
  Payload ID: 18913
  Gene Name: ubiquitin specific peptidase 2
  Uniprot ID: O75604
  ENST ID: ENST00000525735
  CDS Start-End: 213-1403
gtcggccggagcgcgagagccgggacccgggctgttggcggcgcacgccggggaggttgaggcggaggagcgcgcgttcgggcgccgcggacgctgtcctgtagcggtctcgccggcctcggcgtccggactgtggcaccgcgcggggactccccccgcgcccccgctgccaacgttaagcgagggccaaagcccgccgcccgccccccagcatgcgcacctcgtacaccgtgaccctgcccgaggacccccccgccgccccctttcccgccctcgccaaggagctgcggccgcgctcccctctctccccgtccctgctgctctccaccttcgtggggctcctgctcaacaaagccaagaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgg

SEQ ID NO: 197256 - DNA, 4458 bp, Homo sapiens
  Payload ID: 18914
  Gene Name: ubiquitin specific peptidase 20
  Uniprot ID: Q9Y2K6
  ENST ID: ENST00000315480
  CDS Start-End: 159-2903
caggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatcctttgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggacgatgacctgaaacctcgaggcctcacgggcatgaagaacctcgggaactcctgctacatgaacgctgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgacgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagccttgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctgtaagtcgccccggctggtccctccatggcactctgggtcctctcctcactctccagagaccctcacatgtccttttgaacatccaaagagcaggtccctgaaagcaccttcctggaggatgtgggagggccctggacatggcccggccccactgctgagtgcccgtgtccccacagccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccacctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 197257 - DNA, 4371 bp, Homo sapiens
  Payload ID: 18914
  Gene Name: ubiquitin specific peptidase 20
  Uniprot ID: Q9Y2K6
  ENST ID: ENST00000358355
  CDS Start-End: 249-2993
ggcggcgcagttgcgagtgcaggtgagttccgggccgccaccggctgcttctgtgggccgggcctctgagcattggcgaccccagcccggctccgggctgacagggcctggcttcgccaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatcctttgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggacgatgacctgaaacctcgaggcctcacgggcatgaagaacctcgggaactcctgctacatgaacgctgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgacgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagccttgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccacctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgtt

SEQ ID NO: 197258 - DNA, 4315 bp, Homo sapiens
  Payload ID: 18914
  Gene Name: ubiquitin specific peptidase 20
  Uniprot ID: Q9Y2K6
  ENST ID: ENST00000372429
  CDS Start-End: 183-2927
ctcagagggggcgcgcttgactgacaggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctcaccttgactccataggagaggtgaccaaagaggacttgctgctcaaatctaagggaacctgtcagtcgtgtggggtcaccggaccaaacctatgggcctgtctgcaggttgcctgcccctatgttggctgcggagaatcctttgctgaccacagcaccattcatgcacaggcaaaaaagcacaacttgaccgtgaacctgaccacgttccgactgtggtgttacgcctgtgagaaggaggtattcctggagcagcggctggcagcccctctgctgggctcctcttccaagttctctgaacaggactccccgccaccctcccaccctctgaaagctgttcctattgctgtggctgatgaaggagagtctgagtcagaggacgatgacctgaaacctcgaggcctcacgggcatgaagaacctcgggaactcctgctacatgaacgctgccctgcaggccctgtccaattgcccgccgctgactcagttcttcttggagtgtggcggcctggtgcgcacagataagaagccagccctgtgcaagagctaccagaagctggtctctgaggtctggcataagaaacggccaagctacgtggtccccaccagtctgtctcatgggatcaagttggtcaacccaatgttccgaggctatgcccagcaggacacccaagagttccttcgctgcctgatggaccagctgcacgaggagctcaaggagccggtggtggccacggtggcgctgacggaggctcgggactcagattcgagtgacacggatgagaaacgggagggtgaccggagcccatcagaagatgagttcttgtcctgtgactcgagcagtgaccggggtgagggtgacgggcaggggcgtggcgggggcagctcgcaggccgagacggagctgctgatcccagatgaggcgggccgagccatctctgagaaggagcggatgaaggaccgcaagttctcctggggccagcagcgtacaaactcggagcaagtggacgaggacgctgatgtggacactgccatggctgcccttgacgaccagcccgcggaggcccagcccccgtcaccacggtcctccagcccctgccggacgccagagccggacaatgatgctcacctacgcagctcctctcgcccctgcagccccgtccaccaccacgagggccatgccaagctgtctagcagcccccctcgtgcaagccccgtgaggatggcaccgtcgtacgtgctcaagaaagcccaggtattgagtgctggcagccggaggcggaaggagcagcgctaccgcagcgtcatctcagacatctttgacggctccattctcagccttgtgcagtgtctcacctgtgaccgggtatccaccacagtggaaacgttccaggacttatcactgcccattcctggaaaggaggacctggccaagctccattcagccatctaccagaatgtgccggccaagccaggcgcctgtggggacagctatgccgcccagggctggctggccttcattgtggagtacatccgacggtttgtggtatcctgtacccccagctggttttgggggcctgtcgtcaccctggaagactgccttgctgccttctttgccgctgatgagttaaagggtgacaacatgtacagctgtgagcggtgtaagaagctgcggaacggagtgaagtactgcaaagtcctgcggttgcccgagatcctgtgcattcacctaaagcgctttcggcacgaggtgatgtactcattcaagatcaacagccacgtctccttccccctcgaggggctcgacctgcgccccttccttgccaaggagtgcacatcccagatcaccacctacgacctcctctcggtcatctgccaccacggcacggcaggcagtgggcactacatcgcctactgccagaacgtgatcaatgggcagtggtacgagtttgatgaccagtacgtcacagaagtccacgagacggtggtgcagaacgccgagggctacgtactcttctacaggaagagcagcgaggaggccatgcgggagcgacagcaggtggtgtccctggccgccatgcgggagcccagcctgctgcggttctacgtgtcccgcgagtggctcaacaagttcaacaccttcgcggagccaggccccatcaccaaccagaccttcctctgctcccacggaggcatcccgccccacaaataccactacatcgacgacctggtggtcatcctgccccagaacgtctgggagcacctgtacaacagattcgggggtggccccgccgtgaaccacctgtacgtgtgctccatctgccaggtggagatcgaggcactggccaagcgcaggaggatcgagatcgacaccttcatcaagttgaacaaggccttccaggccgaggagtcgccgggcgtcatctactgcatcagcatgcagtggttccgggagtgggaggcgttcgtcaaggggaaggacaacgagccccccgggcccattgacaacagcaggattgcacaggtcaaaggaagcggccatgtccagctgaagcagggagctgactacgggcagatttcggaggagacctggacctacctgaacagcctgtatggaggtggccccgagattgccatccgccagagtgtggcgcagccgctgggcccagagaacctgcacggggagcagaagatcgaagccgagacgcgggccgtgtgatctgctgggctagtctccccatgtgccccaccccgcggaaggcgtgtttgtgcccagaagagaggccgggctgctgcagaaccccgccgtgtaaagaggcagaaaagttggtttggtttgcagtaacgctgcaactagaaaatatatgcacttcaggcttgttgaaacgaccaagactctgtgacgttaatttgggtctttgtcctggcagtgcctctgccagtcactgtcatcgttgtgtcccccacaactgtcctcttgctagctcggcccagctttgtccctggagcccgatgctacccctgtcagacagaggctgcggcctgggccagagtcagggagtagctgctgcttcacggcgtctccactgtgcgattggcccggagccccgaagactcggagggagctgctcagggccggtgagcgcagccagaagccctggccagtgaggagctcacaggtcctccctggtggtcccgccgcacctctgcatctcctgggcgtcaccaggaaggctctgaagtcccgggctgctctcagcacttctcctgcagactgaagactctggactcattgctgattggaacaccaggaggaggttggatttctgccagtgggggatgtttctggaggcagctggtcccccacaccgcgtcctgctgagcctgccccctggattggctgtaatttgcctcgaagttcagcagttcatcttcatgggaaatttgctgagcccccaccagggaaccggatgatgaaacagggatacctcacagcttggccatttgaggcaaaggcagcttcccgagctgatgctaaagaagacagactttcccttcctcccagcagcagcagtgcagagcccacctggagggatgtgggggctgtgcagggtgcagcgctcaggtggatcctgggaagcagcctctggatgctgagtggagggagccactgagcacagcaaggcaccaaagcccctggagaaaccgccagggcgaggtgcgaccatcatcaggatcaaagcagacggggcgtgggtggggaaggggctctgggaccagaccccccacactactgcgtctttgtttctatcagtctttgtagaagcaggtggtggtggaaattccagcaggtgggtcccgcagaggccctgaggcctcacttttcggatcttctgtcccagatcctgctccctccctgctgagcctggggttcccctggcattggccccagccttctgaaagccggcgctgcagccagaggccgcacgctgcactgtcgcgacgcagagaggcttctgtgcaggctgggatcgggccccatgtctgtgctgtctagtttgtgttcaaaatgtcagaataaacacagaataaatgttcccacggcca

SEQ ID NO: 197259 - DNA, 2195 bp, Homo sapiens
  Payload ID: 18915
  Gene Name: ubiquitin specific peptidase 21
  Uniprot ID: Q9UK80
  ENST ID: ENST00000289865
  CDS Start-End: 222-1919
gagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaa

SEQ ID NO: 197260 - DNA, 2095 bp, Homo sapiens
  Payload ID: 18915
  Gene Name: ubiquitin specific peptidase 21
  Uniprot ID: Q9UK80
  ENST ID: ENST00000368001
  CDS Start-End: 164-1819
ctgcggcgggagcgatctgggcaacggctgcggctaaagctgcagccgggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaa

SEQ ID NO: 197261 - DNA, 2342 bp, Homo sapiens
  Payload ID: 18915
  Gene Name: ubiquitin specific peptidase 21
  Uniprot ID: Q9UK80
  ENST ID: ENST00000368002
  CDS Start-End: 378-2075
gcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttatt

SEQ ID NO: 197262 - DNA, 1150 bp, Homo sapiens
  Payload ID: 18915
  Gene Name: ubiquitin specific peptidase 21
  ENST ID: ENST00000492950
  CDS Start-End: 392-1150
gttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggc

SEQ ID NO: 197263 - DNA, 709 bp, Homo sapiens
  Payload ID: 18915
  Gene Name: ubiquitin specific peptidase 21
  ENST ID: ENST00000479344
  CDS Start-End: 358-709
aagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacagatactaagtatttactttgtaccaaacacgatgccaggtactggggatacgatggctgattcgatagatctggttcctgccctcagtgcgtatactgctccccactttcgttgatgtggtagtggtgatgactgagccaaccacctaatgtggaaatgagaggacagcaagattgtgggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtgggg

SEQ ID NO: 197264 - DNA, 5220 bp, Homo sapiens
  Payload ID: 18916
  Gene Name: ubiquitin specific peptidase 22
  Uniprot ID: Q9UPT9
  ENST ID: ENST00000261497
  CDS Start-End: 205-1782
gcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgcggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggcccccccctcccccaagtctcccgccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtctcggctcactgcaacctccacctcctgggttcaagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaa

SEQ ID NO: 197265 - DNA, 4976 bp, Homo sapiens
  Payload ID: 18916
  Gene Name: ubiquitin specific peptidase 22
  Uniprot ID: Q9UPT9
  ENST ID: ENST00000537526
  CDS Start-End: 1-1542
atggcgccgggttggccctcactatcagcgggctcccgacaggaggcgccccagcttgcggccgggggcagcgcctaccaggcagttggcaggcagttccagccccgggccacggcactgcagggcccgagccaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggcccccccctcccccaagtctcccgccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagtgagtggcacagtctcggctcactgcaacctccacctcctgggttcaagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctg

SEQ ID NO: 197266 - DNA, 1906 bp, Homo sapiens
  Payload ID: 18916
  Gene Name: ubiquitin specific peptidase 22
  ENST ID: ENST00000579645
  CDS Start-End: 1-585
atggcgccgggttggccctcactatcagcgggctcccgacaggaggcgccccagcttgcggccgggggcagcgcctaccaggcagttggcaggcagttccagccccgggccacggcactgcagggcccgagccaggttacggcaaccgggggccctgcaaacagctcccgattagggggtgcttttgggtgggaaagcgcaggccctggatggaggcccgacctgcggcgctccagctcatcgccccgcctctttgcggcagagctcaggccggcgcaaaccggttcagtgctaggactgacgtctcgcgccgcccaaccgcagcacgcccccgcctccccagtcctctggaagagacagggaacgtctagccgccagggtcccgggaggcggctctgtaccagacggactatactgagagcctatgacaatagccgaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtga

SEQ ID NO: 197267 - DNA, 306 bp, Homo sapiens
  Payload ID: 18916
  Gene Name: ubiquitin specific peptidase 22
  ENST ID: ENST00000582335
  CDS Start-End: 1-306
tgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagtggagtctccaccaccatcgaccccttctgggacatcagcttggatctccccggctcttccaccccattctggcccctga

SEQ ID NO: 197268 - DNA, 573 bp, Homo sapiens
  Payload ID: 18916
  Gene Name: ubiquitin specific peptidase 22
  ENST ID: ENST00000476111
  CDS Start-End: 199-573
gctgcctggggagcctgggacttcggtgggcggtcccgggcgttcctgcgcgaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggag

SEQ ID NO: 197269 - DNA, 554 bp, Homo sapiens
  Payload ID: 18916
  Gene Name: ubiquitin specific peptidase 22
  ENST ID: ENST00000584538
  CDS Start-End: 234-554
aagagacagggaacgtctagccgccagggtcccgggaggcggctctgtaccagacggactatactgagagcctatgacaatagccgaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtacggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgag

SEQ ID NO: 197270 - DNA, 10549 bp, Homo sapiens
  Payload ID: 18917
  Gene Name: ubiquitin specific peptidase 24
  Uniprot ID: Q9UPU5
  ENST ID: ENST00000294383
  CDS Start-End: 1-7863
atggaatcggaggaggagcagcacatgaccacgctgctgtgcatgggcttctcagaccccgccaccatccgcaaggccctgcgcctggccaagaacgacattaacgaggccgtggcactgctcaccaacgagcggccgggcctcgactacggcggctacgagcccatggacagcggcggtggccccagccccgggcccggcgggggcccgcggggcgacggcggaggtgacggcggcggcggcggcccctcccgcggcgggagcaccggaggcgggggcggcttcgaccccccgcccgcctaccacgaggtggtggacgcggagaagaatgatgagaatggaaactgctcaggggaaggaattgaattccctacaacaaatttatatgaactggaaagccgtgttttgactgatcattggtccatcccttacaagcgagaagaatcactaggcaaatgcctgttggcatctacctacctagcaagacttggtctttccgagtctgatgagaattgtagaaggtttatggacaggtgtatgcctgaagcatttaaaaagctcctgacatcaagtgctgttcacaagtggggtactgaaattcatgaaggaatttacaacatgttgatgctattaatagaactggtcgcagagagaataaaacaagatccaattcccactggtctcctgggtgtgcttacaatggctttcaatcctgataatgaataccattttaaaaacagaatgaaagtgtctcaaaggaattgggcagaagtgtttggagagggaaatatgtttgctgtttcacctgtatcgactttccaaaaggagcctcatggatgggttgtggatttggtaaataagtttggagaattaggtggatttgcagcaatccaagccaagctccattcagaagatatagaacttggggctgtctcagcactgattcagcccttaggagtgtgtgcagagtacctcaattcctccgtggtacagcccatgctagacccagtcattcttactacaatccaggatgtacggagtgtagaagagaaagacctcaaagacaagagattggttagcatccctgagctcttgtctgccgttaagttactttgcatgcgcttccaaccggatctggtgacaattgtggatgaccttcgactagatattctattgcgcatgctgaaatcaccacatttcagtgctaagatgaattctctcaaagaagtaaccaaactaatagaagatagcactttatccaaatctgtgaagaatgctatagatacagacagattattagattggctagttgaaaactcagttctgtcgattgcactggaaggcaacatagaccaagcacaatactgtgaccgtataaagggaattattgaactcttgggtagtaaattgtcgttagatgaactcactaaaatttggaagatacagtcaggacaatcatctactgtgattgagaacattcatactattattgctgcagcggctgtgaaatttaattcagatcagcttaatcatttgtttgttctcattcagaagagctgggagactgagagtgatagagtaagacagaagcttttgagcctgattggacgaataggccgggaagctcgctttgagaccacttctggaaaggttttagacgtactctgggaactggctcaccttccaaccctgcccagtagccttattcagcaggccttggaggagcacctgacaatccttagtgatgcatatgcagtgaaagaagcaatcaagaggagctacatcatcaagtgcatagaagatattaagaggcctggagaatggtcaggtttggaaaaaaacaagaaggatggattcaagtcatctcagcttaataatccccagtttgtatgggtggtaccagctttgcgtcagctccatgaaattactcgctcattcataaaacaaacctatcaaaagcaagacaagagcattattcaagacttgaagaagaattttgaaatagtgaaattggtaacgggaagtttgatcgcttgtcatcggcttgcagctgctgtggccgggcctggaggcttaagtggctcgacactagtggatggccggtacacttaccgggagtatttagaggcacatctaaaatttctagcgtttttcttgcaagaagctactctgtatctgggctggaatcgtgccaaggagatctgggagtgtcttgtaactggccaggatgtttgtgaattagatagagagatgtgttttgaatggtttacaaaaggacagcatgatcttgagagtgatgttcagcagcagctcttcaaggagaaaattcttaaattggagtcatatgaaatcactatgaatggttttaacttatttaaaactttttttgaaaatgtgaatctttgtgatcatcgattgaaaagacaaggagctcagttgtatgtagaaaagctggaattgataggaatggatttcatttggaaaatagccatggaatcacctgatgaagaaattgctaatgaagctattcagctaatcataaactatagttacattaatctaaatcctagattaaagaaggattcagtatctttacataagaaattcattgctgattgctacacaagattagaagcagccagttcagcacttggtggccccactctaacacatgctgtgaccagagcaacaaaaatgcttacagcaactgccatgccaactgtagcaacctcagttcagtctccttatagatctactaaacttgtaataattgagagattgctgcttctggcagagcgctatgtgatcactatagaggatttttactctgttccacgaactattctacctcatggtgcctcatttcatggacatcttttaacccttaatgttacctatgagtctaccaaagataccttcactgtcgaggctcacagtaatgaaaccatagggagtgtccggtggaaaatagccaagcagttgtgctctcctgtggataatatacagatatttacaaatgatagcctgctgacagtgaataaagatcaaaagctactccaccaactgggcttttctgatgaacaaatccttacagtgaagacttctggcagtgggaccccatctgggagttcagcagattcttcaaccagctccagcagcagcagcagtggggtttttagttcttcatatgccatggagcaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaagaaaacattgctgtctgaatcaagttctcagtcctcaaaatctccatccctgtcatcaaagcaacagcaccagccaagtgccagttcaattttagaaagtctgtttcgatcttttgccccgggaatgtctaccttcagagtgctctacaacttagaagttctaagctccaaactcatgccaacagctgatgatgacatggccagaagctgtgccaaatccttctgtgaaaacttcctcaaagctggcggtttgagtttggttgtaaatgtcatgcagagagactccatcccatcagaagtagactatgaaacaaggcagggtgtttattccatctgtctacagcttgcaagatttttacttgtcggacaaacaatgcccacgttattagatgaagacctcaccaaagatggtatagaagcactttcttcccgcccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcatctttctataacttgccctgtgttgctgatttcatcattgatattctgctcggatcaccaagtgctgagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagagactgttatctcagtgtatggagtattttgatttgagatgccagttattagatgatctgacaacttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaga

SEQ ID NO: 197271 - DNA, 614 bp, Homo sapiens
  Payload ID: 18917
  Gene Name: ubiquitin specific peptidase 24
  ENST ID: ENST00000484447
  CDS Start-End: 1-453
gagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcaggttactgaaagtccctcgtttgctctcaccagccttcctggaaatgtggactcttgaaagaaaagctcccgtgctcttgaagtatacctgcttgccaggggagtccaagaaaattttgacatgtatttttaaaaaaagaaaaaaaaacagctttaataccaatcattatagtagaaaaagaaaataaatatgtattgaacacccactgtgtgcaaaca

SEQ ID NO: 197272 - DNA, 370 bp, Homo sapiens
  Payload ID: 18917
  Gene Name: ubiquitin specific peptidase 24
  ENST ID: ENST00000634589
  CDS Start-End: 1-105
cctggagaatggtcaggtttggaaaaaaacaagaaggatggattcaaggcagcaaggtgggctgactggggattatgtctccctgccaggctacacagaaactaagcaaaggtcatctcagcttaataatccccagtttgtatgggtggtaccagctttgcgtcagctccatgaaattactcgctcattcataaaacaaacctatcaaaagcaagacaagagcattattcaagacttgaagaagaattttgaaatagtgaaattggtaacgggaagtttgatcgcttgtcatcggcttgcagctgctgtggccgggcctggaggcttaagtggctcgacactagtggatggccggtacacttaccgggag

SEQ ID NO: 197273 - DNA, 3973 bp, Homo sapiens
  Payload ID: 18918
  Gene Name: ubiquitin specific peptidase 25
  Uniprot ID: Q9UHP3
  ENST ID: ENST00000285679
  CDS Start-End: 370-3537
aagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctaccta

SEQ ID NO: 197274 - DNA, 5216 bp, Homo sapiens
  Payload ID: 18918
  Gene Name: ubiquitin specific peptidase 25
  Uniprot ID: Q9UHP3
  ENST ID: ENST00000285681
  CDS Start-End: 370-3633
aagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcgatcatgatgacaccgaacatgcaaggtattatcatggcgataggtaaatccaggagtgtatatgacaggtgtggccctgaagcagggttctttaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 197275 - DNA, 2158 bp, Homo sapiens
  Payload ID: 18918
  Gene Name: ubiquitin specific peptidase 25
  ENST ID: ENST00000351097
  CDS Start-End: 370-1722
aagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctaccta

SEQ ID NO: 197276 - DNA, 5341 bp, Homo sapiens
  Payload ID: 18918
  Gene Name: ubiquitin specific peptidase 25
  Uniprot ID: Q9UHP3
  ENST ID: ENST00000400183
  CDS Start-End: 370-3747
aagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcgaaacctgaaaatactacaagccaaccactttctaatcagcgagttgtagaggtggcgatccctcatgtagggaaatttatgattgaatcaaaggagggggggtatgatgacgagatcatgatgacaccgaacatgcaaggtattatcatggcgataggtaaatccaggagtgtatatgacaggtgtggccctgaagcagggttctttaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattctaccacagtggt

SEQ ID NO: 197277 - DNA, 687 bp, Homo sapiens
  Payload ID: 18918
  Gene Name: ubiquitin specific peptidase 25
  ENST ID: ENST00000449491
  CDS Start-End: 1-687
gtcctgaaacagttttgcagtcgaaacctgaaaatactacaagccaaccactttctaatcagcgagttgtagaggtggcgatccctcatgtagggaaatttatgattgaatcaaaggagggggggtatgatgacgagatcatgatgacaccgaacatgcaaggtattatcatggcgataggtaaatccaggagtgtatatgacaggtgtggccctgaagcagggttctttaaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaat

SEQ ID NO: 197278 - DNA, 611 bp, Homo sapiens
  Payload ID: 18918
  Gene Name: ubiquitin specific peptidase 25
  ENST ID: ENST00000453553
  CDS Start-End: 1-611
agatcaagagactgaaagattacctcacggtattacaacaaaggctagaaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagcccctt

SEQ ID NO: 197279 - DNA, 3642 bp, Homo sapiens
  Payload ID: 18919
  Gene Name: ubiquitin specific peptidase 26
  Uniprot ID: Q9BXU7
  ENST ID: ENST00000370832
  CDS Start-End: 53-2794
cttcaagattatcaataatcggagatacgtatattttatttgtaaagaaaacatggctgccctattcctacgtggttttgtccaaatagggaactgcaagactgggatatctaagtcaaaagaagcattcattgaagcagtggaaagaaagaagaaagatagactggtgctgtatttcaaaagtggaaaatatagcacttttcggctaagtgataatattcaaaatgtagtccttaaatcctatagaggaaaccaaaatcacctgcatttaactttacaaaataataatggcttgtttattgaaggattatcctccacagatgctgaacaattgaagatattcttggacagagttcatcaaaacgaggttcagccacctgtgagacctggtaagggtgggagtgtcttttctagcacaacacagaaggaaatcaacaaaacttcattccacaaagttgatgagaaatcaagtagcaaatcttttgagatagcaaaaggaagtgggacaggtgtccttcagaggatgcctttgcttacatcaaaattgacacttacttgcggagagttatcagaaaatcagcacaagaagaggaaaagaatgctctcatctagctcagagatgaatgaggaattcttgaaagaaaataattctgtagaatacaagaaatccaaggcagattgttcgaggtgtgtaagctataatcgagagaaacaattgaagttaaaagagttagaagagaataagaaattggaatgtgaatcttcatgcatcatgaacgccactggaaatccttacctagatgacattggtcttctccaagctctcactgagaaaatggttttggtatttctgttacaacaagggtatagtgacggttacacaaagtgggataaattaaaactattttttgaattatttccagagaaaatatgccacggcctccccaatttgggaaacacctgttatatgaatgcagtgttacagtctctactttcaatcccatcgtttgctgatgatttacttaatcagagtttcccatggggtaaaattccccttaatgctcttaccatgtgcttggcacggctacttttttttaaagatacctataatatagaaatcaaggagatgttactcttgaatcttaaaaaggccatttcagcagctgcagagatattccatggcaatgcacagaacgatgctcatgagtttttagctcactgtttagatcaactgaaagataacatggaaaaactcaacacaatttggaagcctaaaagtgaatttggggaagataattttcctaaacaggtttttgctgatgatcctgacaccagtgggttttcttgccctgtcattactaattttgagttagagttgttgcactccattgcttgtaaagcttgtggtcaggttattctcaagacagaactgaataattacctctccatcaaccttccccaaagaataaaagcacatccttcatctattcagtctacttttgatcttttttttggagcagaagagcttgagtataaatgtgcaaaatgtgagcacaagacttccgttggagtgcactcattcagtaggctacctagaatccttattgttcacctcaaacgctatagcttgaatgagttttgtgcattaaagaagaatgaccaggaagtcatcatttccaaatatttaaaggtgtcttctcattgcaatgaaggcaccagaccacctcttcccttgagtgaggatggagaaattacagatttccaattattaaaagttattcgaaagatgacttctggaaacatcagtgtatcatggcctgcaacaaaggaatccaaagatatcctggctccacacattggatcagataaggagtctgaacaaaaaaaaggccagacagtctttaaaggggcaagcagaagacagcagcaaaagtaccttggaaaaaattctaaaccaaatgagctagaatctgtatactcaggagatcgagcattcattgaaaaagaaccgttagctcacttaatgacgtatctggaagatacctcactttgtcagttccacaaagctggaggtaaacctgccagcagcccaggcacacctctctcaaaagttgactttcaaacagtgcccgaaaatccaaaacgaaagaaatatgtgaaaaccagtaagtttgtagcttttgataggattatcaatcctactaaagatttgtatgaagataaaaatatcagaattccagaaagattccaaaaagtgtctgaacagactcagcagtgtgacggtatgagaatctgtgaacaagcccctcagcaggcactgcctcaaagctttccaaagccaggcacccaggggcacacaaagaacctcctaagacctacaaaattaaatctacagaagtctaacaggaattccctacttgcactgggttccaataagaatccaagaaacaaagacattttagataagataaaatctaaagccaaggaaacaaaaagaaatgatgataagggagatcatacctaccggctcattagtgttgtcagccatcttgggaagactctaaagtcaggccattatatctgtgatgcctatgactttgagaaacagatctggttcacttacgatgatatgcgggtgttaggtatccaggaggcccagatgcaggaggataggcgttgcactgggtacatcttcttttacatgcataatgagatctttgaagagatgttgaaaagagaagagaatgcccagcttaatagcaaggaggtagaggagacccttcagaaggaataagaggaacgtactcctccttgtacagatctgcctgactgtctcactcgataccacttcctccatggaaggaaaactgtgaactttatccagagatgaaaatgcaattagtctaggaccaaaggtcaaacagaaacacttaatggggagatctgcattctaatcctgacacagacacctcaatcccatagctctggctgatgagcatccttctctcctacaagactgaaattgtgtttttcatgttcttcttcattttaatatagtcagggtcttgctctgtcatcctggctagagtgcagtccttcaataataactcactgcagcctcaaactcctggcatcaagcgattctctctcagcctcctgaaaagagagggacttatcttcttgcttgagatgggactatagatgtgtgccaccaggcctagctatttttttttttttttttgctttttgcagagacagggtctcactatgctgcccaggttggacttgaactcctggcctcaagcaatcttcctgcctctttccatgttctaatacagtggtttaaaaagtatgctccttaaactagcagcaccaggagcatgggggtagtcatttgaaatgcaaaatcttgggttccactgtagacctactgattcagaaacttggggtaagggatagcaatctgatggagaccgtgatgcttgatacagtttgagaaccactactgtactacatacactaccttggttgtatatttaaattgcttattttgtaaaaggttttgattacatttttgtgtttttcatattaatgtatgccttgcctttgtgaacttattaaaagccaaactcacaaaaatca

SEQ ID NO: 197280 - DNA, 3665 bp, Homo sapiens
  Payload ID: 18919
  Gene Name: ubiquitin specific peptidase 26
  Uniprot ID: Q9BXU7
  ENST ID: ENST00000511190
  CDS Start-End: 471-3212
attttgttttcgatcgttaagtgggcacgtggtggagcgttggtgtgtcaggggtgtcgacttcttccacaaactatttaagagacagcagcaggagggactggactggattgtagaaaacttcaagagttaaggagtgcggagtgctgctcaggtgcctttgtttcaggtcatagtctctgttctatatagcagccaaccacaagggttgattgagtctcactctgttacccaagctggagtgtagtgatgcaatcacagctcactgcagccttgacctcctgaactcaagtgatcctcccacctcagcctcctaactggggctacagattccctgtttctgctttaacctgggctgcttgctaagtgcttgcctctcaggatccttgtggagctgaacttgcaaaacagattggaacttcaagattatcaataatcggagatacgtatattttatttgtaaagaaaacatggctgccctattcctacgtggttttgtccaaatagggaactgcaagactgggatatctaagtcaaaagaagcattcattgaagcagtggaaagaaagaagaaagatagactggtgctgtatttcaaaagtggaaaatatagcacttttcggctaagtgataatattcaaaatgtagtccttaaatcctatagaggaaaccaaaatcacctgcatttaactttacaaaataataatggcttgtttattgaaggattatcctccacagatgctgaacaattgaagatattcttggacagagttcatcaaaacgaggttcagccacctgtgagacctggtaagggtgggagtgtcttttctagcacaacacagaaggaaatcaacaaaacttcattccacaaagttgatgagaaatcaagtagcaaatcttttgagatagcaaaaggaagtgggacaggtgtccttcagaggatgcctttgcttacatcaaaattgacacttacttgcggagagttatcagaaaatcagcacaagaagaggaaaagaatgctctcatctagctcagagatgaatgaggaattcttgaaagaaaataattctgtagaatacaagaaatccaaggcagattgttcgaggtgtgtaagctataatcgagagaaacaattgaagttaaaagagttagaagagaataagaaattggaatgtgaatcttcatgcatcatgaacgccactggaaatccttacctagatgacattggtcttctccaagctctcactgagaaaatggttttggtatttctgttacaacaagggtatagtgacggttacacaaagtgggataaattaaaactattttttgaattatttccagagaaaatatgccacggcctccccaatttgggaaacacctgttatatgaatgcagtgttacagtctctactttcaatcccatcgtttgctgatgatttacttaatcagagtttcccatggggtaaaattccccttaatgctcttaccatgtgcttggcacggctacttttttttaaagatacctataatatagaaatcaaggagatgttactcttgaatcttaaaaaggccatttcagcagctgcagagatattccatggcaatgcacagaacgatgctcatgagtttttagctcactgtttagatcaactgaaagataacatggaaaaactcaacacaatttggaagcctaaaagtgaatttggggaagataattttcctaaacaggtttttgctgatgatcctgacaccagtgggttttcttgccctgtcattactaattttgagttagagttgttgcactccattgcttgtaaagcttgtggtcaggttattctcaagacagaactgaataattacctctccatcaaccttccccaaagaataaaagcacatccttcatctattcagtctacttttgatcttttttttggagcagaagagcttgagtataaatgtgcaaaatgtgagcacaagacttccgttggagtgcactcattcagtaggctacctagaatccttattgttcacctcaaacgctatagcttgaatgagttttgtgcattaaagaagaatgaccaggaagtcatcatttccaaatatttaaaggtgtcttctcattgcaatgaaggcaccagaccacctcttcccttgagtgaggatggagaaattacagatttccaattattaaaagttattcgaaagatgacttctggaaacatcagtgtatcatggcctgcaacaaaggaatccaaagatatcctggctccacacattggatcagataaggagtctgaacaaaaaaaaggccagacagtctttaaaggggcaagcagaagacagcagcaaaagtaccttggaaaaaattctaaaccaaatgagctagaatctgtatactcaggagatcgagcattcattgaaaaagaaccgttagctcacttaatgacgtatctggaagatacctcactttgtcagttccacaaagctggaggtaaacctgccagcagcccaggcacacctctctcaaaagttgactttcaaacagtgcccgaaaatccaaaacgaaagaaatatgtgaaaaccagtaagtttgtagcttttgataggattatcaatcctactaaagatttgtatgaagataaaaatatcagaattccagaaagattccaaaaagtgtctgaacagactcagcagtgtgacggtatgagaatctgtgaacaagcccctcagcaggcactgcctcaaagctttccaaagccaggcacccaggggcacacaaagaacctcctaagacctacaaaattaaatctacagaagtctaacaggaattccctacttgcactgggttccaataagaatccaagaaacaaagacattttagataagataaaatctaaagccaaggaaacaaaaagaaatgatgataagggagatcatacctaccggctcattagtgttgtcagccatcttgggaagactctaaagtcaggccattatatctgtgatgcctatgactttgagaaacagatctggttcacttacgatgatatgcgggtgttaggtatccaggaggcccagatgcaggaggataggcgttgcactgggtacatcttcttttacatgcataatgagatctttgaagagatgttgaaaagagaagagaatgcccagcttaatagcaaggaggtagaggagacccttcagaaggaataagaggaacgtactcctccttgtacagatctgcctgactgtctcactcgataccacttcctccatggaaggaaaactgtgaactttatccagagatgaaaatgcaattagtctaggaccaaaggtcaaacagaaacacttaatggggagatctgcattctaatcctgacacagacacctcaatcccatagctctggctgatgagcatccttctctcctacaagactgaaattgtgtttttcatgttcttcttcattttaatatagtcagggtcttgctctgtcatcctggctagagtgcagtccttcaataataactcactgcagcctcaaactcctggcatcaagcgattctctctcagcctcctgaaaagagagggacttatcttcttgcttgagatgggactatagatgtgtgccaccaggcctagctatttttttttttttttttgctttt

SEQ ID NO: 197281 - DNA, 2618 bp, Homo sapiens
  Payload ID: 18920
  Gene Name: ubiquitin specific peptidase 27, X-linked
  Uniprot ID: A6NNY8
  ENST ID: ENST00000621775
  CDS Start-End: 361-1677
ccccggcccccgccccggccccggccccggcgcggccctgggggcggatgcctggatgtggattttgccgtggggccaccaggctgttctcacgtgaacagctttaaggtgggagagaactggaggcaggaactgcgggttatctaccagtgcttcgtgtggtgtggaaccccagagaccaggaaaagcaaggcaaagtcctgcatctgccatgtgtgtggcacccatctgaacagactccactcttgcctttcctgtgtcttctttggctgcttcacggagaaacacattcacgagcacgcagagacgaaacaacacaacttagcagtagacctgtattacggaggtatatactgctttatgtgtaaggactatgtatatgacaaagacattgagcaaattgccaaagaagagcaaggagaagctttgaaattacaagcctccacctcaacagaggtttctcaccagcagtgttcagtgccaggccttggtgagaaattcccaacctgggaaacaaccaaaccagaattagaactgctggggcacaacccgaggagaagaagaatcacctccagctttacgatcggtttaagaggactcatcaatcttggcaacacgtgctttatgaactgcattgtccaggccctcacccacacgccgatactgagagatttctttctctctgacaggcaccgatgtgagatgccgagtcccgagttgtgtctggtctgtgagatgtcgtcgctgtttcgggagttgtattctggaaacccgtctcctcatgtgccctataagttactgcacctggtgtggatacatgcccgccatttagcagggtacaggcaacaggatgcccacgagttcctcattgcagcgttagatgtcctgcacaggcactgcaaaggtgatgatgtcgggaaggcggccaacaatcccaaccactgtaactgcatcatagaccaaatcttcacaggtggcctgcagtctgatgtcacctgtcaagcctgccatggcgtctccaccacgatagacccatgctgggacattagtttggacttgcctggctcttgcacctccttctggcccatgagcccagggagggagagcagtgtgaacggggaaagccacataccaggaatcaccaccctcacggactgcttgcggaggtttacgaggccagagcacttaggaagcagtgccaaaatcaaatgtggtagttgccaaagctaccaggaatctaccaaacagctcacaatgaataaattacctgtcgttgcctgttttcatttcaaacggtttgaacattcagcgaaacagaggcgcaagatcactacatacatttcctttcctctggagctggatatgacgccgtttatggcctcaagtaaagagagcagaatgaatggacaattgcagctgccaaccaatagtggaaacaacgaaaataagtattccttgtttgctgtggttaatcaccaaggaaccttggagagtggccactataccagcttcatccggcaccacaaggaccagtggttcaagtgtgatgatgccgtcatcactaaggccagtattaaggacgtactggacagtgaagggtatttactgttctatcacaaacaggtgctagaacatgagtcagaaaaagtgaaagaaatgaacacacaagcctactgaagtgacacacagacctacctgcaatggaagatgacgacaccaatactacaactggcatcgagatctaaaggacctacttgaccatggcccatgggcctgacagagtaagaattgaacagtacccagtgtccaaaaggtcctgattggaagagaaatagaaggggagggagaagaggctctagtctaagcagttgatgaaagggaaattaaatggtagaaacactctgggtgaggaaggcaggagcaggaaaatgctgacactggtacatatcctatattcctccaaaagattgtgtgggaaagtgtgggggggaggggggtggtggggggggagtgtgcccttgtaaccgtaaaacatctttctccatgggtgtttcagcttcaattgaccaatcacataacagttatatgtttggggggaaaaagaaaagtttctaaaaaatgtagcccattacatatatgggtatgaaagcagaaaagtggaggaggcagggatatcattgacaaacacctttgccagtttctttgtattcgtgattttttgtgctattaaatgcagtattaaaacaagaaaagcccacctgggctagtgaaaggagaggaaataagggggcttgtaaaaggggagccgtcgctccaaaagtagagaagacaagaaatgctgtaagataagcaaccaacgcagacaggcctcagctaagagtatagtgtgtgtgtgttaaaaaaaaaaaaaaaaaaagaaaaaaaaaagctgtatgatatacttgagcaaatcaatgaacctctttgcgattgttttatcatctgtaaaatgcagataattcctaccttaaagggttattgttaaagataaaatgatataaaaatgtgtcaaagtataaagtaaaaggcttggaactttgtagggactcagtaaacgtttgttggatccaaacctgaaa

SEQ ID NO: 197282 - DNA, 4669 bp, Homo sapiens
  Payload ID: 18921
  Gene Name: ubiquitin specific peptidase 28
  Uniprot ID: Q96RU2
  ENST ID: ENST00000003302
  CDS Start-End: 70-3303
agtcctgagaggctgggccggcggcggctgcggcgggagaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttac

SEQ ID NO: 197283 - DNA, 542 bp, Homo sapiens
  Payload ID: 18921
  Gene Name: ubiquitin specific peptidase 28
  ENST ID: ENST00000544750
  CDS Start-End: 405-542
agaccggtgacccgcggctgggcgcctcggccatgactgcggagctgcagcaggacgacgcggccggcgcggcagacggccacggctcgatttttaaggagggggaggagctgcgtgatgaatagaaagtctactgatgatgatctcctgttcccaatgtctaagaagattgaaatcaatataaggacttctgatctaagaatctggtgagagtgaaagaaccctggtttgagagaaaagctaatgtctgtatgaagaaacttgggaagagggcaatttgagcatgtcttctagtgttacttcggaatgttataacttaacaccacctcctcacccctcaagtactgcactttttcaagagaaaacgggaaatctgtgccagttgttcaaatacgagtttggagatgagaaactatatttgtcgtacaaagctggcagacagataccctcagagctgccaaatgctgttaaatcaactgagagaaatcacaggcattcaggacccttcctttctccatgaagctctgaaggccagtaatggt

SEQ ID NO: 197284 - DNA, 683 bp, Homo sapiens
  Payload ID: 18921
  Gene Name: ubiquitin specific peptidase 28
  ENST ID: ENST00000535607
  CDS Start-End: 1-122
tgtttgctctaatgatgggatcaaatagaaaatttgtagacccgtctgcagccctggatctattaaagggagcattccgatcatctgaggaacagcagcagcagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattacc

SEQ ID NO: 197285 - DNA, 733 bp, Homo sapiens
  Payload ID: 18921
  Gene Name: ubiquitin specific peptidase 28
  ENST ID: ENST00000545608
  CDS Start-End: 1-154
gagaaatatcatgtttatgcaagagcttcagtatttgtttgctctaatgatgggatcaaatagaaaatttgtagacccgtctgcagccctggatctattaaagggagcattccgatcatctgaggaacagcagcagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaagtgcactgctcggtttctgaccagacatccaaggaaagtacagaaagctcttctcaggatgttgaaagtaccttttcttctcctgaagattctttacccaagtctaaaccactgacatcttctcggtcttccatggaaatgccttcacagc

SEQ ID NO: 197286 - DNA, 582 bp, Homo sapiens
  Payload ID: 18921
  Gene Name: ubiquitin specific peptidase 28
  ENST ID: ENST00000538224
  CDS Start-End: 1-582
taactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgagcttaaagaagctgaacccaagaagcccatgccccaggaaacaaaccttgcagagcagtcagaacagcccccaaaggctaatgatgcagagtctactgcccagcctaattctgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaag

SEQ ID NO: 197287 - DNA, 732 bp, Homo sapiens
  Payload ID: 18921
  Gene Name: ubiquitin specific peptidase 28
  ENST ID: ENST00000537642
  CDS Start-End: 1-732
tgcggagctgcagcaggacgacgcggccggcgcggcagacggccacggctcgaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcaggaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgat

SEQ ID NO: 197288 - DNA, 3015 bp, Homo sapiens
  Payload ID: 18921
  Gene Name: ubiquitin specific peptidase 28
  ENST ID: ENST00000540438
  CDS Start-End: 66-650
ctgagaggctgggccggcggcggctgcggcgggagaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcaggatgcttcttcaggagttccaccgtgcaggcctgagagggttttcatttgaggagcatgttgggatgaggagttgtatattcatacaggagatatttttaaagaaaattaacttatgaaagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaagtctgcatctagcctgtttcaggacattgctcattcttcctacttgactgccagaggtgccattgcagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtac

SEQ ID NO: 197289 - DNA, 1081 bp, Homo sapiens
  Payload ID: 18921
  Gene Name: ubiquitin specific peptidase 28
  ENST ID: ENST00000538475
  CDS Start-End: 1-1081
gcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatg

SEQ ID NO: 197290 - DNA, 3498 bp, Homo sapiens
  Payload ID: 18921
  Gene Name: ubiquitin specific peptidase 28
  ENST ID: ENST00000544967
  CDS Start-End: 89-2350
gtgcatttctaaccagctatcaggaagttgctgaatttaaaatgttgtctctgtggagccagaagataggctttagatagtcatagtgatgtcttttttaaaaagtctctctctttgcctaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtac

SEQ ID NO: 197291 - DNA, 3431 bp, Homo sapiens
  Payload ID: 18921
  Gene Name: ubiquitin specific peptidase 28
  ENST ID: ENST00000545540
  CDS Start-End: 234-2996
agtcctgagaggctgggccggcggcggctgcggcgggagaccggtgacccgcggctgggcgcctcggccatgactgcggagctgcagcaggacgacgcggccggcgcggcagacggccacggctcgaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaacta

SEQ ID NO: 197292 - DNA, 567 bp, Homo sapiens
  Payload ID: 18921
  Gene Name: ubiquitin specific peptidase 28
  ENST ID: ENST00000537490
  CDS Start-End: 1-274
caatccagaattgtctccttttcctaaaagcagcagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcctacctgtacctgagtagggagaacccactgcctccatattttcggagggtaaaagtacagtgattaactcctatgcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtg

SEQ ID NO: 197293 - DNA, 1900 bp, Homo sapiens
  Payload ID: 18921
  Gene Name: ubiquitin specific peptidase 28
  Uniprot ID: Q96RU2
  ENST ID: ENST00000537706
  CDS Start-End: 28-1779
ggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtagaatgaaaattgatgggaaagtagtcaaggcatgtgctaatggtagatacaaaaatcaaatttgatagttttcttttaaacccaatgggaatccccctaagataaaagaataaacttaagatataaa

SEQ ID NO: 197294 - DNA, 561 bp, Homo sapiens
  Payload ID: 18921
  Gene Name: ubiquitin specific peptidase 28
  ENST ID: ENST00000540925
  CDS Start-End: 329-561
gggagaccggtgacccgcggctgggcgcctcggccatgactgcggagctgcagcaggacgacgcggccggcgcggcagacggccacggctcgattgaaatcaatataaggacttctgatctaagaatctggtgagagtgaaagaaccctggtttgagagaaaagctaatgtctgtatgaagaaacttgggaagagggcaatttgagcatgtcttctagtgttacttcggaatgttataacttaacaccacctcctcacccctcaagtactgcactttttcaagagaaaacgggaaatctgtgccagttgttcaaatacgagtttggagatgagaaactatatttgtcgtacaaagctggcagacagataccctcagagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggag

SEQ ID NO: 197295 - DNA, 3705 bp, Homo sapiens
  Payload ID: 18922
  Gene Name: ubiquitin specific peptidase 29
  Uniprot ID: Q9HBJ7
  ENST ID: ENST00000254181
  CDS Start-End: 455-3223
gagatttccagagccatgggagccggaagtccaaggaactgtacctccatcatgacgactccggttacgtaaaaacattcaaacagaaaatgctggccaggctcatgcctgtaatcccagcactttgggaggccgaggcgggaggatcgcttgtgcccaggagttggagaccagcctgggcaacatagcgctatggagtctaatccaggcactttggaaggctgaggctggaggatcgattgaggccaggagtttgggaccaccctgggcaacatagcaagatctcatttctgaaaaaagaattatcatccactcacccagaacagctctccaaacttaacagccgtggcagtcagagctctgcctgcagtgtgaccatggacagctctccaaagcttaaacttcagtaaattgactcaagtttcttcggaaagaactgttacataaagaaaggatgatatctctaaaggtatgtggattcatccaaatttggagccagaagactgggatgactaagctgaaagaagctctcattgaaacagtgcaaagacaaaaggaaattaaactggtggtcactttcaaatctggaaaatttataagaatttttcagctgagcaacaacattagaagtgtggtccttagacattgtaaaaaaagacaaagtcacctgcgtttaactttgaaaaacaacgtgttcttgtttattgacaaattatcctacagagatgctaaacagttgaatatgttcctggacataatccaccaaaacaaatctcagcaacccatgaaatctgatgatgattggagtgtgtttgaaagcaggaatatgctgaaggaaattgacaaaacttcattttacagcatttgtaacaagccaagttatcagaagatgcctttgtttatgtcaaaatcaccaacacatgtgaaaaaggggatattagaaaatcaaggtgggaaggggcaaaacacactatcatctgatgtacagacaaatgaggacattctgaaggaagataaccctgtaccaaacaagaaatataagacagattccttgaaatatatacaaagcaataggaagaacccatcaagtttagaggatttagaaaaagatagagatttgaaactcgggccttcattcaataccaactgtaatggaaatcctaacctagatgagactgttcttgcaacccagactctcaatgccaaaaatggtttgacatctccattggaaccagagcacagccagggtgacccaagatgcaacaaagcccaggtgcctcttgactctcattcacagcaactgcagcaggggttccccaatttgggaaacacctgttacatgaatgcagttttacaatcgctatttgcaattccatcttttgctgatgacttactcactcaaggtgtcccatgggaatatattccctttgaggctcttattatgaccttgacccagctgcttgctttgaaagatttctgtagtacaaagatcaagagagaattacttgggaatgttaaaaaagtcatttcagcagttgcagaaatattttctggcaacatgcagaatgatgctcatgagtttttaggtcagtgtttagaccagctgaaagaagacatggaaaaattaaatgccactttgaatactgggaaagaatgtggggatgaaaattcatctccacaaatgcatgttggtagtgctgccaccaaagtgtttgtttgccctgttgttgctaattttgagtttgaattgcagctctcccttatttgtaaagcttgtggtcatgctgttctcaaggtagaacctaataattatctctccatcaacctgcaccaagaaacaaaaccacttcctttgtccattcagaattctttagatcttttctttaaagaagaagagcttgaatataactgtcagatgtgtaagcagaagagttgtgttgcaaggcatacatttagtaggctctccagggtccttatcattcatctgaaacgctatagcttcaacaatgcttggttgctggtgaagaataacgagcaagtttatattcccaaatctttaagtttatcttcttattgcaatgaaagcaccaaaccacctcttcccttgagcagtagtgcacctgttgggaaatgtgaagtcctggaagtctctcaggagatgatttctgagatcaacagcccattgacaccatcaatgaagctgacctcagaatccagtgattccctggttctacccgttgaaccagacaagaatgccgacctacaaagattccagagagactgtggagatgcaagccaagagcagcatcagagagacctggaaaatggctctgcactagagtcagaattggtccactttagagatagggcaatcggtgaaaaggagcttccagtggctgactcactgatggaccagggagacatttctcttcctgtgatgtatgaagatggagggaagctgatcagcagcccagacacaaggcttgtcgaggttcatcttcaagaggtgcctcaacatccagaacttcagaagtatgagaaaaccaatacattcgtagagttcaattttgacagtgtcactgagtccaccaatggcttttatgactgtaaagaaaacaggattccagaaggatctcaaggaatggctgaacagctccagcagtgtattgaggagagcatcatagatgaatttcttcagcaggcaccacctccaggtgttaggaagctggatgcccaggaacatacagaagagaccctcaatcagtctacagaattaagacttcaaaaggctgacctgaatcaccttggggcactgggttctgacaacccaggaaacaaaaacattttagatgcagagaacacaagaggtgaagccaaggaactaacaagaaacgtgaagatgggggatcctctccaggcctacagactcatcagtgttgtcagccatatcgggagctccccaaattcaggccattacatcagcgatgtgtatgactttcagaagcaggcctggttcacatacaacgatctatgtgtatcagaaatctcagagaccaaaatgcaggaggcgaggcttcactctgggtatatcttcttttacatgcacaatgggatttttgaggagctgttaagaaaagcagagaactctcggctacctagcacacaggcaggggtgatccctcagggggaatacgaaggtgactctttgtacagacctgcttgacagactcactcggcctcacttcatccttgcaaagagaatcctgtacttcatccttgcaaagagaatcctgtacttcactcagaatgaaggaacaagtatctcaggatgaaatctcaatgaaaaacacttattttgggggaatatctattttaactgcttcagacacctagatcccagaactcaggcgcatatgcatattttccctgcaagattagaatggtgctcttcacgttttgacggtggttttcaaaatgttgttcttcaaccagcaacagcaacagctagggactgattagaaatgcaaattcttgggtcactctctagaccaactgatgcagaaacaggaggtgtgagccagcaatcagatggagattctagtgctcatgaaagtttgaagaacactggtaatgtgtggagtatcttggtgtattttgctactgttgatatggattgcttatgttatataaacgattttcattaaa

SEQ ID NO: 197296 - DNA, 437 bp, Homo sapiens
  Payload ID: 18922
  Gene Name: ubiquitin specific peptidase 29
  ENST ID: ENST00000600020
  CDS Start-End: 346-437
gctggcccaggcaccacgcgactctaagcgcgcccaaagcgaccctctgcgcaaactacccccggggacgacgtcacccgtgaggcgctatggagtctaatccaggcactttggaaggctgaggctggaggatcgattgaggccaggagtttgggaccaccctgggcaacatagcaagatctcatttctgaaaaaagaattatcatccactcacccagaacagctctccaaactccgtggcagtcagagctctgcctgcagtgtgaccatggacagctctccaaagcttaaacttcagtaaattgactcaagtttcttcggaaagaactgttacataaagaaaggatgatatctctaaaggtatgtggattcatccaaatttggagccagaagactgggatgactaagctgaaagaagctctcattgaaacagtgca

SEQ ID NO: 197297 - DNA, 3284 bp, Homo sapiens
  Payload ID: 18922
  Gene Name: ubiquitin specific peptidase 29
  Uniprot ID: Q9HBJ7
  ENST ID: ENST00000598197
  CDS Start-End: 34-2802
gtgcttttcttctttaggttacataaagaaaggatgatatctctaaaggtatgtggattcatccaaatttggagccagaagactgggatgactaagctgaaagaagctctcattgaaacagtgcaaagacaaaaggaaattaaactggtggtcactttcaaatctggaaaatttataagaatttttcagctgagcaacaacattagaagtgtggtccttagacattgtaaaaaaagacaaagtcacctgcgtttaactttgaaaaacaacgtgttcttgtttattgacaaattatcctacagagatgctaaacagttgaatatgttcctggacataatccaccaaaacaaatctcagcaacccatgaaatctgatgatgattggagtgtgtttgaaagcaggaatatgctgaaggaaattgacaaaacttcattttacagcatttgtaacaagccaagttatcagaagatgcctttgtttatgtcaaaatcaccaacacatgtgaaaaaggggatattagaaaatcaaggtgggaaggggcaaaacacactatcatctgatgtacagacaaatgaggacattctgaaggaagataaccctgtaccaaacaagaaatataagacagattccttgaaatatatacaaagcaataggaagaacccatcaagtttagaggatttagaaaaagatagagatttgaaactcgggccttcattcaataccaactgtaatggaaatcctaacctagatgagactgttcttgcaacccagactctcaatgccaaaaatggtttgacatctccattggaaccagagcacagccagggtgacccaagatgcaacaaagcccaggtgcctcttgactctcattcacagcaactgcagcaggggttccccaatttgggaaacacctgttacatgaatgcagttttacaatcgctatttgcaattccatcttttgctgatgacttactcactcaaggtgtcccatgggaatatattccctttgaggctcttattatgaccttgacccagctgcttgctttgaaagatttctgtagtacaaagatcaagagagaattacttgggaatgttaaaaaagtcatttcagcagttgcagaaatattttctggcaacatgcagaatgatgctcatgagtttttaggtcagtgtttagaccagctgaaagaagacatggaaaaattaaatgccactttgaatactgggaaagaatgtggggatgaaaattcatctccacaaatgcatgttggtagtgctgccaccaaagtgtttgtttgccctgttgttgctaattttgagtttgaattgcagctctcccttatttgtaaagcttgtggtcatgctgttctcaaggtagaacctaataattatctctccatcaacctgcaccaagaaacaaaaccacttcctttgtccattcagaattctttagatcttttctttaaagaagaagagcttgaatataactgtcagatgtgtaagcagaagagttgtgttgcaaggcatacatttagtaggctctccagggtccttatcattcatctgaaacgctatagcttcaacaatgcttggttgctggtgaagaataacgagcaagtttatattcccaaatctttaagtttatcttcttattgcaatgaaagcaccaaaccacctcttcccttgagcagtagtgcacctgttgggaaatgtgaagtcctggaagtctctcaggagatgatttctgagatcaacagcccattgacaccatcaatgaagctgacctcagaatccagtgattccctggttctacccgttgaaccagacaagaatgccgacctacaaagattccagagagactgtggagatgcaagccaagagcagcatcagagagacctggaaaatggctctgcactagagtcagaattggtccactttagagatagggcaatcggtgaaaaggagcttccagtggctgactcactgatggaccagggagacatttctcttcctgtgatgtatgaagatggagggaagctgatcagcagcccagacacaaggcttgtcgaggttcatcttcaagaggtgcctcaacatccagaacttcagaagtatgagaaaaccaatacattcgtagagttcaattttgacagtgtcactgagtccaccaatggcttttatgactgtaaagaaaacaggattccagaaggatctcaaggaatggctgaacagctccagcagtgtattgaggagagcatcatagatgaatttcttcagcaggcaccacctccaggtgttaggaagctggatgcccaggaacatacagaagagaccctcaatcagtctacagaattaagacttcaaaaggctgacctgaatcaccttggggcactgggttctgacaacccaggaaacaaaaacattttagatgcagagaacacaagaggtgaagccaaggaactaacaagaaacgtgaagatgggggatcctctccaggcctacagactcatcagtgttgtcagccatatcgggagctccccaaattcaggccattacatcagcgatgtgtatgactttcagaagcaggcctggttcacatacaacgatctatgtgtatcagaaatctcagagaccaaaatgcaggaggcgaggcttcactctgggtatatcttcttttacatgcacaatgggatttttgaggagctgttaagaaaagcagagaactctcggctacctagcacacaggcaggggtgatccctcagggggaatacgaaggtgactctttgtacagacctgcttgacagactcactcggcctcacttcatccttgcaaagagaatcctgtacttcatccttgcaaagagaatcctgtacttcactcagaatgaaggaacaagtatctcaggatgaaatctcaatgaaaaacacttattttgggggaatatctattttaactgcttcagacacctagatcccagaactcaggcgcatatgcatattttccctgcaagattagaatggtgctcttcacgttttgacggtggttttcaaaatgttgttcttcaaccagcaacagcaacagctagggactgattagaaatgcaaattcttgggtcactctctagaccaactgatgcagaaacaggaggtgtgagccagcaatcagatggagattctagtgctcatgaaagtttgaagaacactggtaatgtgtggagtatcttggtgtattttgctactgttgatatggattgcttatgttatataaacgattttcattaaa

SEQ ID NO: 197298 - DNA, 533 bp, Homo sapiens
  Payload ID: 18922
  Gene Name: ubiquitin specific peptidase 29
  ENST ID: ENST00000600940
  CDS Start-End: 495-533
atcatgacgactccggttacgtaaaaacattcaaacagaaaatgctggccaggctcatgcctgtaatcccagcactttgggaggccgaggcgggaggatcgcttgtgcccaggagttggagaccagcctgggcaacatagtgagaccctccccccacccatctctacaaaaaattttaaaattagctagctgagatcatgccactgcactccagcctggacaacaaagcgctatggagtctaatccaggcactttggaaggctgaggctggaggatcgattgaggccaggagtttgggaccaccctgggcaacatagcaagatctcatttctgaaaaaagaattatcatccactcacccagaacagctctccaaacttaacagccgtggcagtcagagctctgcctgcagtgtgaccatggacagctctccaaagcttaaacttcagtaaattgactcaagtttcttcggaaagaactgttacataaagaaaggatgatatctctaaaggtatgtggattcatccaaatttgg

SEQ ID NO: 197299 - DNA, 5311 bp, Homo sapiens
  Payload ID: 18923
  Gene Name: ubiquitin specific peptidase 3
  ENST ID: ENST00000268049
  CDS Start-End: 1-1497
atgcaatcaccaccacacttggcagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaattactctctttgttggtttttttggttttggggcatacttgtttgcggggaggtaagatgggagtaaagaccaaatacatgtaatgtttaaaaaaaatgctgtgactcactgacatggtataggtgttaccagtgaggtaaagccatggcgtctgcctccttttgaatcagtatctcattcccccttagttgtaccactggaagtcacgacatgtccattatagacttacttactgcttgtgtttggcatctgagtctgaggtgtgaccctctgggatttacttggatcatcacccgcacttcagtttatcactggggggtgtgcttccacaggaggaaatttagaatcttcgctgctctgggttttaacacctctctctggcctatcctgattgataggacaagttgaaaatactgttggagtaagtaagtggagttttcgttttgttttttgggggtttttggagacaagagtctctctctgttgcccaggctggagtgcagtggcacgatctcagctcattgcaacctcggcctcccgagtagcaattctcctgcctcaacctcctgagtagctgggattacaggtgcccaccactacacctggctaattttttttttgtatttttagtaaagacgggggtttaccatgttggctagggtggtctcaacctccctcctgacctcaggtgatccgcctgcctcagcctcccaaagtgctgagattacaggcgtgagccatcacgcccagacagttttgtttttaaaaaacagatttaactcaaagattcaaatttggaaccagaatcccatttaaagaaagcagttgtggtttctacaagtgttctaagacagtcctgtggtggttttttttttttcttttttttggttgggggcggtgggggttggtagacatagcctaccaattctccacaagggacaaaatgtatcttgtgttaagccaacgagactttctggcaattttttttttttttttttaatggagtcttactctgtccctcaggctggagtgcagtgtggcatgatcacagctcactgtagcctcaacctcccaggctcaagcgatcctcccacttcagcctcgaagtagctggcaccaccacacccagctaatttttaatatttttactagagatggggtttcaccacgttgcccaggctggtcttgcactcctgggctcaagtgatccacccaccttggcttcccaaggtgctagcattacaggcatgagccaccacgcccagcctgttctattaaaaacatcttgacctttttttttttttaagtttatgatataaaaacagtctggtggctttccctcaggttggatatctgaagttgtgggagcagatgtagctccatttccattttaatattaactggataaatcccacatcttcccagaacacatctgctaaacactttaacatgacaaggagcaaattacaattatgtgtaaacttatatcatccagtacaatggcccctagccacatgtgactgaaatttaaattagaaactcagtgccttcagtcacactagccacatttcaagtgctcagcacccacatacggcgtaggacaatgctggtctaaattttcactccaaagaataaaactttgccatcatgtttaggtcttacaactttgagtcctaaaagataatagggagatgtgtgcttaaattaatttacaatgctaaattatattaggttaaactgtatgaaaccctgctatttgatgagttctgatctacaaaaatgacagctccacctgatctgatgtatcacacattaacatcacatctaattcaacctgaaatgtgagtctcctttgatcttgcaaagtatctcctatgaatccgggctcttttgcttagaaggtagacagctgtaacctctaacattgatacttcgatcttcagtctctctgaatgggcagctgttaaacagtaaaggcctgggcagagttgatggtgaaaaaaagctgtatttttataccaaatggaacttcagcaacacgttggactactttgtcgggcagagtggtcttcagacaggtgatgctgttggcttaagagatgaacacgtcttctctctgaatttgtttttattggttggttttacttgaacagaaacgtttgaatggtgtgaagattctttagaaaagtgattggatccatctcaattgtgcacttgaacagcagtgatgtaaatgtgcttatttgtgttttcatttttaactgtgcagccttaccacacctattttgaaagctgatcttttgtcctcttcagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccggggtgagtgttaaatgtgtatctcgcctgtggaacctactcagcagcttggtttctggggttgggggcatatttatttcttaaagccaaacctctccttcattggtttagtgtacataagtctatttagatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctgaactgtttttaaaaatatcattaaaagtctgttctctttccttttga

SEQ ID NO: 197300 - DNA, 2333 bp, Homo sapiens
  Payload ID: 18923
  Gene Name: ubiquitin specific peptidase 3
  Uniprot ID: Q9Y6I4
  ENST ID: ENST00000380324
  CDS Start-End: 130-1692
ctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaa

SEQ ID NO: 197301 - DNA, 2077 bp, Homo sapiens
  Payload ID: 18923
  Gene Name: ubiquitin specific peptidase 3
  ENST ID: ENST00000538686
  CDS Start-End: 1-20
gtagctacagtacatactgatgagtgaagaatggtttgctttgggaatattttcttagttcttcaaggacatgatgtggaagtcatgacttgagtaacttcaatagcactaacaacaggaattgaaaaaaacttagaattttaaagctgagaaagagttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaa

SEQ ID NO: 197302 - DNA, 5474 bp, Homo sapiens
  Payload ID: 18923
  Gene Name: ubiquitin specific peptidase 3
  Uniprot ID: Q9Y6I4
  ENST ID: ENST00000540797
  CDS Start-End: 230-1660
cccggatctcggagttacacgttctacggagcggggcgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaagttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaattactctctttgttggtttttttggttttggggcatacttgtttgcggggaggtaagatgggagtaaagaccaaatacatgtaatgtttaaaaaaaatgctgtgactcactgacatggtataggtgttaccagtgaggtaaagccatggcgtctgcctccttttgaatcagtatctcattcccccttagttgtaccactggaagtcacgacatgtccattatagacttacttactgcttgtgtttggcatctgagtctgaggtgtgaccctctgggatttacttggatcatcacccgcacttcagtttatcactggggggtgtgcttccacaggaggaaatttagaatcttcgctgctctgggttttaacacctctctctggcctatcctgattgataggacaagttgaaaatactgttggagtaagtaagtggagttttcgttttgttttttgggggtttttggagacaagagtctctctctgttgcccaggctggagtgcagtggcacgatctcagctcattgcaacctcggcctcccgagtagcaattctcctgcctcaacctcctgagtagctgggattacaggtgcccaccactacacctggctaattttttttttgtatttttagtaaagacgggggtttaccatgttggctagggtggtctcaacctccctcctgacctcaggtgatccgcctgcctcagcctcccaaagtgctgagattacaggcgtgagccatcacgcccagacagttttgtttttaaaaaacagatttaactcaaagattcaaatttggaaccagaatcccatttaaagaaagcagttgtggtttctacaagtgttctaagacagtcctgtggtggttttttttttttcttttttttggttgggggcggtgggggttggtagacatagcctaccaattctccacaagggacaaaatgtatcttgtgttaagccaacgagactttctggcaattttttttttttttttttaatggagtcttactctgtccctcaggctggagtgcagtgtggcatgatcacagctcactgtagcctcaacctcccaggctcaagcgatcctcccacttcagcctcgaagtagctggcaccaccacacccagctaatttttaatatttttactagagatggggtttcaccacgttgcccaggctggtcttgcactcctgggctcaagtgatccacccaccttggcttcccaaggtgctagcattacaggcatgagccaccacgcccagcctgttctattaaaaacatcttgacctttttttttttttaagtttatgatataaaaacagtctggtggctttccctcaggttggatatctgaagttgtgggagcagatgtagctccatttccattttaatattaactggataaatcccacatcttcccagaacacatctgctaaacactttaacatgacaaggagcaaattacaattatgtgtaaacttatatcatccagtacaatggcccctagccacatgtgactgaaatttaaattagaaactcagtgccttcagtcacactagccacatttcaagtgctcagcacccacatacggcgtaggacaatgctggtctaaattttcactccaaagaataaaactttgccatcatgtttaggtcttacaactttgagtcctaaaagataatagggagatgtgtgcttaaattaatttacaatgctaaattatattaggttaaactgtatgaaaccctgctatttgatgagttctgatctacaaaaatgacagctccacctgatctgatgtatcacacattaacatcacatctaattcaacctgaaatgtgagtctcctttgatcttgcaaagtatctcctatgaatccgggctcttttgcttagaaggtagacagctgtaacctctaacattgatacttcgatcttcagtctctctgaatgggcagctgttaaacagtaaaggcctgggcagagttgatggtgaaaaaaagctgtatttttataccaaatggaacttcagcaacacgttggactactttgtcgggcagagtggtcttcagacaggtgatgctgttggcttaagagatgaacacgtcttctctctgaatttgtttttattggttggttttacttgaacagaaacgtttgaatggtgtgaagattctttagaaaagtgattggatccatctcaattgtgcacttgaacagcagtgatgtaaatgtgcttatttgtgttttcatttttaactgtgcagccttaccacacctattttgaaagctgatcttttgtcctcttcagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccggggtgagtgttaaatgtgtatctcgcctgtggaacctactcagcagcttggtttctggggttgggggcatatttatttcttaaagccaaacctctccttcattggtttagtgtacataagtctatttagatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctgaactgtttttaaaaatatcattaaaagtctgttctctttccttttga

SEQ ID NO: 197303 - DNA, 2439 bp, Homo sapiens
  Payload ID: 18923
  Gene Name: ubiquitin specific peptidase 3
  ENST ID: ENST00000558157
  CDS Start-End: 106-276
gagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttg

SEQ ID NO: 197304 - DNA, 2217 bp, Homo sapiens
  Payload ID: 18923
  Gene Name: ubiquitin specific peptidase 3
  ENST ID: ENST00000559257
  CDS Start-End: 1-1331
ataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccagggcttttcccttgtgccatgttgtctccagcaatatatgtggcttctggctcagagcttctgctgaggcagggcctcgcgctgagtcacatggctccttggaacaagaaaactttctcagaagtccccacacgggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctgaactgtttttaaaaatatcattaaaagtctgttctctttc

SEQ ID NO: 197305 - DNA, 561 bp, Homo sapiens
  Payload ID: 18923
  Gene Name: ubiquitin specific peptidase 3
  ENST ID: ENST00000559771
  CDS Start-End: 184-561
tttgcctctgtgtgggaagtcagcaggaccagatgcccctctcttctttggctctccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaa

SEQ ID NO: 197306 - DNA, 1693 bp, Homo sapiens
  Payload ID: 18923
  Gene Name: ubiquitin specific peptidase 3
  ENST ID: ENST00000559711
  CDS Start-End: 88-1383
atttttggagaatgggggaagaatgtaaagatggagatgaccgaatgaggaatattgttttgccattaaataagtgaatagtgcgaaatggaaaataccgagggttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgagg

SEQ ID NO: 197307 - DNA, 545 bp, Homo sapiens
  Payload ID: 18923
  Gene Name: ubiquitin specific peptidase 3
  ENST ID: ENST00000560070
  CDS Start-End: 146-545
ttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaagttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactca

SEQ ID NO: 197308 - DNA, 5499 bp, Homo sapiens
  Payload ID: 18923
  Gene Name: ubiquitin specific peptidase 3
  ENST ID: ENST00000559192
  CDS Start-End: 7-174
gtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggatttggggaacctgaaaatactttgtacagataacttttttttaaaaaagaagaaaagtagaagcacttaaattctgcagttgaagagacagattcctctcctagattttgagaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaagaattactctctttgttggtttttttggttttggggcatacttgtttgcggggaggtaagatgggagtaaagaccaaatacatgtaatgtttaaaaaaaatgctgtgactcactgacatggtataggtgttaccagtgaggtaaagccatggcgtctgcctccttttgaatcagtatctcattcccccttagttgtaccactggaagtcacgacatgtccattatagacttacttactgcttgtgtttggcatctgagtctgaggtgtgaccctctgggatttacttggatcatcacccgcacttcagtttatcactggggggtgtgcttccacaggaggaaatttagaatcttcgctgctctgggttttaacacctctctctggcctatcctgattgataggacaagttgaaaatactgttggagtaagtaagtggagttttcgttttgttttttgggggtttttggagacaagagtctctctctgttgcccaggctggagtgcagtggcacgatctcagctcattgcaacctcggcctcccgagtagcaattctcctgcctcaacctcctgagtagctgggattacaggtgcccaccactacacctggctaattttttttttgtatttttagtaaagacgggggtttaccatgttggctagggtggtctcaacctccctcctgacctcaggtgatccgcctgcctcagcctcccaaagtgctgagattacaggcgtgagccatcacgcccagacagttttgtttttaaaaaacagatttaactcaaagattcaaatttggaaccagaatcccatttaaagaaagcagttgtggtttctacaagtgttctaagacagtcctgtggtggttttttttttttcttttttttggttgggggcggtgggggttggtagacatagcctaccaattctccacaagggacaaaatgtatcttgtgttaagccaacgagactttctggcaattttttttttttttttttaatggagtcttactctgtccctcaggctggagtgcagtgtggcatgatcacagctcactgtagcctcaacctcccaggctcaagcgatcctcccacttcagcctcgaagtagctggcaccaccacacccagctaatttttaatatttttactagagatggggtttcaccacgttgcccaggctggtcttgcactcctgggctcaagtgatccacccaccttggcttcccaaggtgctagcattacaggcatgagccaccacgcccagcctgttctattaaaaacatcttgacctttttttttttttaagtttatgatataaaaacagtctggtggctttccctcaggttggatatctgaagttgtgggagcagatgtagctccatttccattttaatattaactggataaatcccacatcttcccagaacacatctgctaaacactttaacatgacaaggagcaaattacaattatgtgtaaacttatatcatccagtacaatggcccctagccacatgtgactgaaatttaaattagaaactcagtgccttcagtcacactagccacatttcaagtgctcagcacccacatacggcgtaggacaatgctggtctaaattttcactccaaagaataaaactttgccatcatgtttaggtcttacaactttgagtcctaaaagataatagggagatgtgtgcttaaattaatttacaatgctaaattatattaggttaaactgtatgaaaccctgctatttgatgagttctgatctacaaaaatgacagctccacctgatctgatgtatcacacattaacatcacatctaattcaacctgaaatgtgagtctcctttgatcttgcaaagtatctcctatgaatccgggctcttttgcttagaaggtagacagctgtaacctctaacattgatacttcgatcttcagtctctctgaatgggcagctgttaaacagtaaaggcctgggcagagttgatggtgaaaaaaagctgtatttttataccaaatggaacttcagcaacacgttggactactttgtcgggcagagtggtcttcagacaggtgatgctgttggcttaagagatgaacacgtcttctctctgaatttgtttttattggttggttttacttgaacagaaacgtttgaatggtgtgaagattctttagaaaagtgattggatccatctcaattgtgcacttgaacagcagtgatgtaaatgtgcttatttgtgttttcatttttaactgtgcagccttaccacacctattttgaaagctgatcttttgtcctcttcagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccggggtgagtgttaaatgtgtatctcgcctgtggaacctactcagcagcttggtttctggggttgggggcatatttatttcttaaagccaaacctctccttcattggtttagtgtacataagtctatttagatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctgaactgtttttaaaaatatcattaaaagtctgttctctttccttttga

SEQ ID NO: 197309 - DNA, 1681 bp, Homo sapiens
  Payload ID: 18923
  Gene Name: ubiquitin specific peptidase 3
  ENST ID: ENST00000560202
  CDS Start-End: 1-321
cattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccagggcttttcccttgtgccatgttgtctccagcaatatatgtggcttctggctcagagcttctgctgaggcagggcctcgcgctgagtcacatggctccttggaacaagaaaactttctcagaagtccccacacgggtgggtgacagaaacagtttgtggcaacacaaatctctctccatggtggagaaacctttgcttatccactgtattctactcagtgtatagtgatgacagatgtactagaattaaaccagtcaagtgtactggcccggggtgagtgttaaatgtgtatctcgcctgtggaacctactcagcagcttggtttctggggttgggggcatatttatttcttaaagccaaacctctccttcattggtttagtgtacataagtctatttagatacacttatcccactttaatctccaccagcccctaaactctctcctgtaccctctgttgctgaagtggcctcttcacctgggccctggaaaagccgatggaaaaagtctgttcctgcagccaaggcctgggtcccaggtgactaggagtagccataggaaggtgaggaaggagaagtgggcatgtggtgtcatctgtagtccaaggtctctgcgtctcgtcagtgggtgcagtgccttccccctcaggtgtgagcgtgatggactctagactgccttccatgagtgttggtcatgctatgatgtcatcatttgccattaaaacccagtttgtatgatgccaagaggattaattgtgcaagtgactgattcatttaaattgtaatcacatcccttttctgcttcaccaacctga

SEQ ID NO: 197310 - DNA, 1742 bp, Homo sapiens
  Payload ID: 18923
  Gene Name: ubiquitin specific peptidase 3
  ENST ID: ENST00000558285
  CDS Start-End: 102-1613
aaatgcattcacaaagcacggatttgcaacttcagcattcctacatagccatggaatttataacttaatcacaggaaaatggggagaaattgggaaataacatgatgcaattggtatattgtgtatttttctttttattagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaat

SEQ ID NO: 197311 - DNA, 542 bp, Homo sapiens
  Payload ID: 18923
  Gene Name: ubiquitin specific peptidase 3
  ENST ID: ENST00000561442
  CDS Start-End: 147-542
tttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgagatggagtttcaccattttaccaaagctggtctcgaactcctggactcaagcaatctgcctgcctcggcctcccaaagtgttgggactacagtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgatttt

SEQ ID NO: 197312 - DNA, 584 bp, Homo sapiens
  Payload ID: 18923
  Gene Name: ubiquitin specific peptidase 3
  ENST ID: ENST00000559873
  CDS Start-End: 67-306
agttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaa

SEQ ID NO: 197313 - DNA, 958 bp, Homo sapiens
  Payload ID: 18923
  Gene Name: ubiquitin specific peptidase 3
  ENST ID: ENST00000557884
  CDS Start-End: 129-299
tcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcagtgtgccggtccaacaaaagcccttgggtctgtttgacttgttcaagtgtccactgtggaaggatttggggaacctgaaaatactttgtacagataacttttttttaaaaaagaagaaaagtagaagcacttaaattctgcagttgaagagacagattcctctcctagattttgagaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttc

SEQ ID NO: 197314 - DNA, 554 bp, Homo sapiens
  Payload ID: 18923
  Gene Name: ubiquitin specific peptidase 3
  ENST ID: ENST00000559276
  CDS Start-End: 437-554
ctttgtgtgccttcggttctcatctggttttcaggagagttaaatgtttaagtggttttaggaggaagacttgagtctgagacatgttttagaggctggggctcttcccaccctctccatggcccagcatatgtgatagcttctaccttctggagaatggctctagctcaggagaggatagagcttcttcatctcctccatgcaaaggagccctcctgccatcttgaagagcttgaggctgaggtgagaacagggacagaggaagattctgaagccgtagctgaagaggaggcagtgaaaggagcctaccttcaaatgtttatctggtgtgactgtattatgccctcagagagtactgtatgttgcccaggctggcctcgaactctaggctcaagtgattcttctgcctcagcctcccaagtagctgggactacagatgcaatcaccaccacacttggcagtgtgccggtccaacaaaagcccttgggtctgtttgacttgttcaagtgtccactgtggaaggtatgtgaatggccatgcaaaaaaacattatg

SEQ ID NO: 197315 - DNA, 3742 bp, Homo sapiens
  Payload ID: 18924
  Gene Name: ubiquitin specific peptidase 30
  Uniprot ID: Q70CQ3
  ENST ID: ENST00000257548
  CDS Start-End: 94-1647
gttccgctgtctcgggaaccgtcgtatccctcggtccggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccctacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagcttggggctgtataaaaaaataatccctgccctgagttgacacctggcttaggaaggaagggctgactatggggctgcagtctctctgaacctcagtttcctcatttgtgaagtgaagggttagatttgatgaccaccaaagttcagcccttttcacgaaaaggagaaagcagcttttgactttttaaaaaacatataactacagctggcatctagtattgtcatgttgctctaggtccatattctgaatttattcatttccaatagcctaatacaaaaagtatatattgagcactttcttcccttttcaggtaagtctctgaatgcagcccagggccaaaggaattttgatgacacagtagtacctatgttttaagctatatttttaatttagaaaaatggataccaaattcaaaccgactcatcagaggtaagatttggaatcagacctttccaaaaggtcatctgaggtaaggctaagaccgcacttcctctgctgggggtgagctggcagacacaccaaacagtgccttggcagcagctcacagtgcaggaagcccaggtgatcactcttctgctgggcccaggctgcaccctgaggactcagtaactcactctcaacagaatattctgtgcaggctctccaggctctgggcgtcagggtgcaaggggcagcttgaactgtacggtccgtcctgcactcacccgatgcagaccttgactttgatgttgaaatgaacacacttgttttacccaagtctggtggaacaaatgcccaatcatgtgaccttaaagtgtactgcaaagctgtagctttaagtaattgctgttctgccactgcttactctgaaatctaccatcaaagaaagatagagaaaaggggctgagccttggaatatatggttataagcagatctttctttggtcagagaccagggtttgagccaaggctgtaaatgtgaacaatagctgtgcaaagccttttaacctgacttcttcattttgtaaattattatgcattaagtagcagcccaataatctgatttctagttttattttcaaagtaagtagcttcttttgggaaaaacctaagttaaactagtagttttgccataataactgctgatttatgtatttgctaaaggtacttttgtatctgctgtgtattatagcaataaaataatcattttgttagaaaaaaatca

SEQ ID NO: 197316 - DNA, 2483 bp, Homo sapiens
  Payload ID: 18924
  Gene Name: ubiquitin specific peptidase 30
  ENST ID: ENST00000392784
  CDS Start-End: 577-2037
atccccattgttgcatagctgggaaagggagctggacaacctggtaccttttcgattatggattcaaatgtctctgaagtattgacaggatttcaccatgttagccaggatggtctcgatctcctgatctcgtgatccacctgccttggccccccaaagtgctgggattacaggcgtgaaccaccacaccagcctaaagcagcattttttggtgtgtctgtaagggtgtttcaagaggagattgctgtgtgagtctgagtggacaaagttcaggaagatctgccctcgatgtgtgaatgagcaccatcaaatcagctagaggcccagacagaacagaaacagaggaaagagacagagtcttgctatgtaacccaggctggtctcgaactccggcttcaagcaatcctcctgcctcagcctcccaaagtgctgggattatagaccggacactaagacccagcgctgaggacaaaaggaagcaagctctgcatatttgaagtgttgcaaactagggtccatcctctgggccagccctctcctctagtgacttactcagagtgtgttggatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccctacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgagcacgtgcagttcaatgagttcctgatgatggacatttacaagtaccacctccttggacataaacctagtcaacacaaccctaaactgaacaagaacccagggcctacactggagctgcaggatgggccgggagcccccacaccagttctgaatcagccaggggcccccaaaacacagatttttatgaatggcgcctgctccccatctttattgccaacgctgtcagcgccgatgcccttccctctcccagttgttcccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaag

SEQ ID NO: 197317 - DNA, 476 bp, Homo sapiens
  Payload ID: 18924
  Gene Name: ubiquitin specific peptidase 30
  ENST ID: ENST00000536393
  CDS Start-End: 38-476
gcggaggagacggtttcaggcctccggtgcggctgcaatgctgagctcccgggccgaggcggcgatgaccgcggccgacagggccatccagcgcttcctgcggaccggggcggccgtcagatataaagtcatgaagaactggggagttataggtggaattgctgctgctcttgcagcaggaatatatgttatttggggtcccattacagaaagaaagaagcgtagaaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaa

SEQ ID NO: 197318 - DNA, 534 bp, Homo sapiens
  Payload ID: 18924
  Gene Name: ubiquitin specific peptidase 30
  ENST ID: ENST00000539121
  CDS Start-End: 249-534
agggttggaggcctgggcccgtaggtgggaggactgacgggctccagtccttcggcaacaccaattctgtctgcactccccagtttccatcttgaacttcgtggttttaagcacagacctggggagacagacaggcatgattcagagccatgttccttcactcactgtgaccaagttgggctcttagtttcttctgctataaaaatgaaagtgatagtagaacctgcatctgtggggttgttttaaaaatgagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgc

SEQ ID NO: 197319 - DNA, 826 bp, Homo sapiens
  Payload ID: 18924
  Gene Name: ubiquitin specific peptidase 30
  ENST ID: ENST00000536723
  CDS Start-End: 295-826
gctgtctcgggaaccgtcgtatccctcggtccggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagccctatgaggtaggtcttatggattgtccccattgtacagatgaggaaactgaggcttagaaggtgaagtgatgccaaatgaaatagcaaagccaggattgaaccagaataagatataaagtcatgaagaactggggagttataggtggaattgctgctgctcttgcagcaggaatatatgttatttggggtcccattacagaaagaaagaagcgtagaaaagggcttgtgcctggccttgttaatttagggaacacctgcttcatgaactccctgctacaaggcctgtctgcctgtcctgctttcatcaggtggctggaagagttcacctcccagtactccagggatcagaaggagcccccctcacaccagtatttatccttaacactcttgcaccttctgaaagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagag

SEQ ID NO: 197320 - DNA, 805 bp, Homo sapiens
  Payload ID: 18924
  Gene Name: ubiquitin specific peptidase 30
  ENST ID: ENST00000377883
  CDS Start-End: 76-183
ccgtcgtatccctcggtccggcggcggcggcggcggtagcggaggagacggtttcaggcctccggtgcggctgcaatgctgagctcccgggccgaggcggcgatgaccgcggccgacagggccatccagcgcttcctgcggaccggggcggccgtcagccttgtcctgccaagaagttactgatgatgaggtcttagatgcaagctgcttgttggatgtcttaagaatgtacagatggcagatctcatcatttgaagaacaggatgctcacgaattattccatgtcattacctcgtcattggaagatgagcgagaccgccagcctcgggtcacacatttgtttgatgtgcattccctggagcagcagtcagaaataactcccaaacaaattacctgccgcacaagagggtcacctcaccctacatccaatcactggaagtctcaacatccttttcatggaagactcactagtaatatggtctgcaaacactgtgaacaccagagtcctgttcgatttgatacctttgatagcctttcactaagtattccagccgccacatggggtcacccattgaccctggaccactgccttcaccacttcatctcatcagaatcagtgcgggatgttgtgtgtgacaactgtacaaagattgaagccaagggaacgttgaacggggaaaaggtggaacaccagaggaccacttttgttaaacagttaaaactagggaagctccctcagtgtctctgcatccacctacagcggctgagctggtccagccacggcacgcctctgaagcggcatgag

SEQ ID NO: 197321 - DNA, 615 bp, Homo sapiens
  Payload ID: 18924
  Gene Name: ubiquitin specific peptidase 30
  ENST ID: ENST00000470117
  CDS Start-End: 1-276
cccgactacagctcctccacatacctcttccggctgatggcagttgtcgtccaccatggagacatgcactctggacactttgtcacttaccgacggtccccaccttctgccaggaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtgttctcagaggggaggtacctttgtctaatcaacgtttccacttagatcttttatttttaataagcaggccc

SEQ ID NO: 197322 - DNA, 10699 bp, Homo sapiens
  Payload ID: 18925
  Gene Name: ubiquitin specific peptidase 31
  Uniprot ID: Q70CQ4
  ENST ID: ENST00000219689
  CDS Start-End: 1-4059
atgtccaaggtaacggcgcctgggtccgggccgccggcggcggcgagcgggaaggagaagcgctccttcagcaagcggctgtttcggagcggccgcgctggcggcggcggcgcggggggccccggggcgtccgggccggccgcgccttcctcgccctcctcgccctcctctgcacgctcggtgggcagcttcatgagccgcgttctcaagacgctgtccacgctctcgcaccttagctctgagggcgccgccccagaccgcggcggcctccgcagctgcttcccgcccgggccggccgccgcgcccacgccgccgccgtgcccgccgccgcccgcctctcccgcgccgcccgcttgcgccgccgagccggtgcccggcgtggcggggctccgcaaccacggcaacacgtgcttcatgaacgccacgctgcagtgcctcagcaacaccgagctcttcgccgagtacctggcgctgggccagtaccgggcggggcggcccgagccctcgcctgacccggagcagcctgcgggccgcggcgcgcagggccagggcgaggtcactgagcagctggcgcacctggtgcgggccctctggaccctggagtacaccccgcagcacagccgcgacttcaagactattgtgtcaaagaatgcactgcagtaccggggaaattcccaacatgatgcccaggagtttctgctgtggcttttggaccgagttcatgaagacctcaaccattcagtgaagcagagtggccagcctcctctgaagccaccatcagagactgatatgatgcctgagggaccatctttccctgtctgtagcacttttgtacaagaactctttcaagcgcaatacagatcttctttgacgtgtcctcattgtcagaaacagagcaacacttttgatcctttcctttgcatttctttgccaattcctctgccccacacaaggcctctctatgtcactgtagtgtatcaaggcaaatgttctcactgcatgaggattggtgtggccgtacctctgtctgggactgtcgccagacttcgggaagcagtgtctatggaaacaaagatccccactgatcagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaagatttggactgccttttgtgctgcacttagagaagacaatagcttgggaccttctgcagaaggaaatcttggagaagatgaagtatttcttgaggcccacggtttgcattcaggtgtgtccattcagcttgcgtgtggtcagtgttgttggaataacatatttgctgccccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacagcgtactgtaagaactctgtggacggcctctggtactgcttcgatgacagcgatgtgcagcagctgtcagaagatgaggtctgcacgcagacagcatacatcctcttctaccagaggcggacagccatcccgtcatggtcagccaacagctcggtggcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttaataggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttcaa

SEQ ID NO: 197323 - DNA, 2142 bp, Homo sapiens
  Payload ID: 18925
  Gene Name: ubiquitin specific peptidase 31
  ENST ID: ENST00000567975
  CDS Start-End: 138-2075
catgtagatgcttcataaatatttgtagaatgaatgtatgagtgcttgtctattccattctcttgccaattctttagactcagacttacattataaagtattcatccctatccttgcattttattactacaaatttcatgcgtcaggaagtctgccttacatcttttcatcttaactggggatattcggacaggcacgacatgacacagggtctgggaattgatgctgacctcggggtgaggacatcaacgccccccagctcagctcgtaacaccttcatgagggtgtgtgtggctcagggctggccgagggaccccagcctgacctctatgcctgttttcttctctgcaggctccacaagttcttccctgtgtgaacactgggtgagccggctcccgggcagcaagccagccagcgtgacctctgcagcttcctccagacgcacctccctggcgtcgctctctgagtccgtggagatgactggagaaaggagtgaagatgatggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctcccacc

SEQ ID NO: 197324 - DNA, 1560 bp, Homo sapiens
  Payload ID: 18925
  Gene Name: ubiquitin specific peptidase 31
  ENST ID: ENST00000563525
  CDS Start-End: 1-799
ccaggaggagcagcccttgtgccacccaatagtagaaagggcattaaaatcttgtggaccaggtggcactgctcatgtgaaattagtagtcgagtgggacaaggagacaagagatttcttatttgtaaatactgaggatgagtatattcctgatgcagaaagtgttcgtctgcaaagggagcgtcatcatcagcctcaaacctgcactttatcccagtgtttccaactgtacaccaaagaggagcggcttgcccccgatgatgcctggcgttgcccacactgtaagcagctgcagcagggaagcattacgttaagcctctggactctgcctgatgtgcttattatacatctaaagagatttcggcaggaaggagacaggcgcatgaaacttcagaacatggtcaaattccccttgactggcctggacatgacacctcacgtggttaagaggagccagagcagctggagtttgccatcgcattggtccccgtggagacggccctatggactcgggagggaccctgaggactacatctatgacctgtatgctgtgtgcaatcaccatggcaccatgcaaggggggcactacacaggtctgcagtgtgagaggctgcgtgtctgtgctggcgagtccttcagacgggtttgcttgtggcagggtgacttgactttagagcctcatttcccctccggtaggcagtgtgccaactgtgagggcagtttccatcctctggatctctgcccaagagcaaataaacgaacattcttcctccttttcctgagttgggtcgtccagtaggtagctgactgattggggagtggtatgtgcagatggcattgtctggtcaactgaggatttgctctttgtttacctaacctgcgctccccatttacggttttgctagatagagttccttgagttctatcttctctctcattttaaatgattgtgaactactttttttttttttaattaaagatgagctgttgctgtgttgcccaggctggagtacagtagctattcacagatgtgattatcacacactacagccttgaacttctgggctcaagcaagtctcctgccttattctccagagtagctgggatacaagtgcatgacacttttatagtgtctttaaagtgacttagaagggtttttctttttgttttaaggttaaattgaccttgtcatttataaaagcaactatgttcatcatgaaatttagagtctagaggtggaaagaataccatcatccatgggcttatcactgagataaccactggtaacattttttttaattgcgataaaatatacataagaaaatgtaccattttaaccatttttaagtgtacagttcagtgacattaagtacactcacattgttgtgcaaccattatcactatccatctctacaagttttttaatcttcccagacttaaactctgtacctaataaacactaattcccattttctctcccttcagccatgacaagcaccatactttctgtctctgtgaatttgactactcttggtacctcttttaaatggaatcattcaa

SEQ ID NO: 197325 - DNA, 5171 bp, Homo sapiens
  Payload ID: 18926
  Gene Name: ubiquitin specific peptidase 32
  Uniprot ID: Q8NFA0
  ENST ID: ENST00000300896
  CDS Start-End: 196-5010
acgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaa

SEQ ID NO: 197326 - DNA, 1868 bp, Homo sapiens
  Payload ID: 18926
  Gene Name: ubiquitin specific peptidase 32
  Uniprot ID: Q8NFA0
  ENST ID: ENST00000393003
  CDS Start-End: 37-1209
caggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattaggactctggaaactgaccaaatatatacaagaaattgagaagcatttattcaagaactactaatccttggtgagaacaatggaagtgtgtggtaatttaaccaggagcagctttcatttcctcccatccagcaagtctgcatgggctgtcagtctgattcatgatttgaaggagagcaggaataaatgcctgtccaaggataataaaataaatacataccatcatggtggtaaacagtgagggaaaactgacatcaccagcttggggataaaatactggttaggggaagcagcagactaacaacagaccagtcaaatttttaacagggaacaggatcaccatagtgagccttagcaagctttctcatgtccccagtgatctgtagactgcttgtacaaggctatacacaaactcaggagaaaccaaagtgggctttagcactttattcttccctagttgaaggtgaagccttgcatgtgcagaaagtaaaagccagggtaggcttgtaacctgcccaaactttaaatgcattccccaaaccatgtacagatccatcaggaaaagggtgtgaatgttactggctaaacacaaccagtaaactgctgagagcacaacctctcagcagtcattggctgaccagtaagttaggctcaccccaagaaggccaagcttaaaaataaaaacagataataaaaaa

SEQ ID NO: 197327 - DNA, 739 bp, Homo sapiens
  Payload ID: 18926
  Gene Name: ubiquitin specific peptidase 32
  ENST ID: ENST00000591768
  CDS Start-End: 1-739
gaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcatttaccgagaggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaag

SEQ ID NO: 197328 - DNA, 691 bp, Homo sapiens
  Payload ID: 18926
  Gene Name: ubiquitin specific peptidase 32
  ENST ID: ENST00000589335
  CDS Start-End: 292-691
gtggcaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaa

SEQ ID NO: 197329 - DNA, 2563 bp, Homo sapiens
  Payload ID: 18926
  Gene Name: ubiquitin specific peptidase 32
  ENST ID: ENST00000590133
  CDS Start-End: 22-2563
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtgg

SEQ ID NO: 197330 - DNA, 486 bp, Homo sapiens
  Payload ID: 18926
  Gene Name: ubiquitin specific peptidase 32
  ENST ID: ENST00000589552
  CDS Start-End: 1-264
gatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcattt

SEQ ID NO: 197331 - DNA, 668 bp, Homo sapiens
  Payload ID: 18926
  Gene Name: ubiquitin specific peptidase 32
  ENST ID: ENST00000593071
  CDS Start-End: 1-524
ggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaatt

SEQ ID NO: 197332 - DNA, 578 bp, Homo sapiens
  Payload ID: 18926
  Gene Name: ubiquitin specific peptidase 32
  ENST ID: ENST00000588898
  CDS Start-End: 120-578
aaagccacggcaaccgccaacacagaacccagccccccaccccgctcccatttcctcattcttaggggtggctgcagctggcccctccagctgggatctggactagggaacggagcaagatgtgcggggtcgagcgaagactttggcagagcgcacagcaggccaggagaggctggcgccccttctcccaagaatactgtcagatgctgatcctgacaccacctgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagag

SEQ ID NO: 197333 - DNA, 436 bp, Homo sapiens
  Payload ID: 18926
  Gene Name: ubiquitin specific peptidase 32
  ENST ID: ENST00000590297
  CDS Start-End: 1-262
gcgaagactttggcagagcgcacagcaggccaggagaggctggcgccccttctcccaagaatactgtcagatgctgatcctgacaccacctggaattccttctcccggaccttccttcgtgtcctctgggcccgggcccagttgtccccactcagtgtggccctgttcttcgcctgccttcgcgacagtgcggtgggaccgccgtcggcccgggcctcccctgccacccagcggccacctcgggcacaggagaggggcatagcggcttcaagtaggggtagcccggaggcccggagctttggaggagcaccctttgagtccagaaactttttaacttgtcctctatgccagcatgttcagcaaacgtcttgttgttattgttgtcgttgttgttgttgtaaggggaggaataaaccttccacttatccgcctccaa

SEQ ID NO: 197334 - DNA, 4045 bp, Homo sapiens
  Payload ID: 18926
  Gene Name: ubiquitin specific peptidase 32
  ENST ID: ENST00000592339
  CDS Start-End: 71-3895
gttcctttcctcacagcaacagataccacactacagtgggacaatttagacactcctgttaacctaacgtatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaata

SEQ ID NO: 197335 - DNA, 4155 bp, Homo sapiens
  Payload ID: 18927
  Gene Name: ubiquitin specific peptidase 33
  Uniprot ID: Q8TEY7
  ENST ID: ENST00000357428
  CDS Start-End: 1-2829
atgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgt

SEQ ID NO: 197336 - DNA, 2917 bp, Homo sapiens
  Payload ID: 18927
  Gene Name: ubiquitin specific peptidase 33
  Uniprot ID: Q8TEY7
  ENST ID: ENST00000370792
  CDS Start-End: 348-2834
ggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaatgattagatgaaa

SEQ ID NO: 197337 - DNA, 4502 bp, Homo sapiens
  Payload ID: 18927
  Gene Name: ubiquitin specific peptidase 33
  Uniprot ID: Q8TEY7
  ENST ID: ENST00000370793
  CDS Start-End: 348-3176
ggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgt

SEQ ID NO: 197338 - DNA, 4327 bp, Homo sapiens
  Payload ID: 18927
  Gene Name: ubiquitin specific peptidase 33
  Uniprot ID: Q8TEY7
  ENST ID: ENST00000370794
  CDS Start-End: 262-2997
ggagacaccggaaggagccgcggctgctgcgggaagtggccagttcaggaggcggaccccccgagggcagcgctgcggggccgttttccggccctcctgacgcgacactgcccctctccgagagctgagaaggaaaagaggagcttgcggaggtgcggctgcaggccgttgttggtcgagctggcgggtcccgcgggccaggccgtggaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctctttctaattgcccacctttgacacagttttttcttgattgtggaggactagctcgaacagataagaaacctgccatttgtaaaagttatctcaaactaatgacagagctgtggcataaaagcaggccaggatctgttgtgcctactactctgtttcaaggaattaaaactgtaaatccaacatttcgggggtattctcagcaggatgctcaagaattccttcgatgtttaatggatttgcttcatgaagaattgaaagagcaagtcatggaagtagaagaagatccgcaaaccataaccactgaggagacaatggaagaagacaagagccagtcggatgtagattttcagtcttgtgaatcttgtagcaacagtgatagagcagaaaatgaaaatggctctagatgcttttctgaagataataatgaaacaacaatgttaattcaggatgatgaaaacaattcagaaatgtcaaaggattggcaaaaagagaagatgtgcaataagattaataaagtaaattctgaaggcgaatttgataaagatagagactctatatctgaaacagtcgacttaaacaaccaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaaagttttgtgaagggtaaagatggagatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgtaaaa

SEQ ID NO: 197339 - DNA, 2866 bp, Homo sapiens
  Payload ID: 18927
  Gene Name: ubiquitin specific peptidase 33
  ENST ID: ENST00000481579
  CDS Start-End: 1-1370
accaggaaactgtcaaagtgcaaatacacagcagagcttcagaatatatcactgatgtccattcgaatgacctgtctacaccacagatccttccatcaaatgaaggtgttaatccacgtttatcggcaagccctcctaaatcaggcaatttgtggccaggattggcaccaccacacaaaaaagctcagtctgcatctccaaagagaaaaaaacagcacaagaaatacagaagtgttatttcagacatatttgatggaacaatcattagttcagtgcagtgtctgacttgtgacagggtgtctgtaaccctcgagacctttcaagatctgtccttgccaattcctggcaaggaagaccttgctaagctgcattcatcaagtcatccaacttctatagtcaaagcaggatcatgtggcgaagcatatgctccacaagggtggatagcttttttcatggaatatgtgaagaggtttgttgtctcatgtgtccctagctggttttggggtccagtagtaaccttgcaagattgtcttgctgccttctttgccagagatgaactaaaaggtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggaagagcagcgaagaggcacaaaaagagaggagaaggatatcaaatttattgaacataatggaaccaagcctccttcagttttatatttctcgacagtggcttaataaatttaagacctttgccgaacctggccctatttcaaataatgactttctttgtattcatggaggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggatcctccaggtcctattgacaatactaagattgcagtcactaaatgtggtaatgtgatgcttaggcaaggagcagattctggccagatttctgaagaaacatggaattttctgcagtctatttatggtggagggcctgaagttatcctgcgacctccggttgttcatgttgatccagatatacttcaagcagaagaaaaaattgaagtagaaactcggtctttgtaatttttaggatgtagagagttctaatgaggaatcattttcatgtgccctgacatgtacacatgcgaaaacattcctaaaagcgtgtttatttgctttattttttttcatcatttatcccatttatttcttcttagtgggcattatggaagaatatattaaaatgtgtaatataccacaggttggtatatttagttttaaatacttaccataaagtctttcagtgtaatttttttttgagacagagtcttgctttgtcacccaggctggagtgctgtggtgttacctcagctcactgcagcctccacctcctgggttcaagcgattctcctgcctcagcctctcgagtagctgggattacaggcacctgccaccatgcccggctaatttttgtattttagtagagatggggtttcaccatgttggccaggctagtctcaaactcctgacctcaggtgatccacccacctcggcctcccaaagtgctgggattacaggtgtgagccacagcgcctggcccagtgtaatatttttgaaagaggagggacaattgtgaaatcagtaggttatctttaatctttacactacatgcagatccatagtatcctttgtagtgttgtaaatacttttgctttgaaaactttttcattgtcctaaatcaccctgactctgaccagtctttcagttctccaaaagcccaatttaattgtatagttttgtcatggcttcatataataaagagcctattttaagttgaaagtagtagtcagaaaattgttaatttcctaaagctcaggaaactagggtgtcactttttttgcactgcagcatatacactaactagcttattaaaatttacaaaatgtctttttgaatgtatcaaggatatatttagtttgagtggaatttgtcagcagatatcagtaacttattgccgcttatattgtacaatgttaaacttcaattcctgtaacctggttagtattaatgtcagtgactaaaaaacttagagttagttttagggcactttttattttgagagcatgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatgttgttaaaattagctcaataaaaatgtctttaaaatgt

SEQ ID NO: 197340 - DNA, 661 bp, Homo sapiens
  Payload ID: 18927
  Gene Name: ubiquitin specific peptidase 33
  ENST ID: ENST00000527390
  CDS Start-End: 1-419
gtgacaatatgtacagttgtgaaaaatgcaaaaagttgagaaatggagtgaagttttgtaaagtacaaaactttcctgagattttgtgcatccaccttaaaagattcagacatgaactaatgttttccaccaaaatcagtacccatgtttcatttccgctagaaggcttggatcttcagccatttcttgctaaggatagtccagctcaaattgtgacatatgatcttctgtcagtcatttgccatcatggaactgcaagtagtggacactatatagcctactgccgaaacaatctaaataatctctggtatgaatttgatgatcagagtgtcactgaagtttcagaatctactgtacaaaatgcagaagcttacgttcttttctataggtgttcctccaagaaaagctggttatattgaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcgggtaaaaaagtgatgcttttcaaattgatctaggataaagatgaagacctgacaattatcagagttatatgatattaataaaa

SEQ ID NO: 197341 - DNA, 549 bp, Homo sapiens
  Payload ID: 18927
  Gene Name: ubiquitin specific peptidase 33
  ENST ID: ENST00000530709
  CDS Start-End: 218-549
aagggtcctcaggggttcttccctggaagcgggaggtgcagtgctttacttccaactatgtggtcaattttgtttacaagagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcg

SEQ ID NO: 197342 - DNA, 949 bp, Homo sapiens
  Payload ID: 18927
  Gene Name: ubiquitin specific peptidase 33
  ENST ID: ENST00000524536
  CDS Start-End: 343-949
ggccgttgttggtcgagctggcgggtcccgcgggccaggccgtggaggctttggtgtcaggatgatgctggcttcataaaatgagttacggaggattccttctttttatattgattggaatagtttcagaaggaatggtaccagctcctctttgtacctctggtagaattcggctgtgaatccgtctggtcctggactttttttgagctcctgaaggaagcactaaacatggaaaggaacaaccggtaccagccactgcaaaaacatgccaaattgtaaagaccatcgatgttaggaagaaactgcctcaactaatgagcaaaataaccagctaacatcgtaatgacaggatcaaattcacacataacgatattaaccttaaaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaactgtgaaccttaccactcttcgagtatggtgttatgcttgcagcaaagaagtatttttggataggaaattaggaactcagccttcattgcctcatgtaagacaacctcaccaaatacaagaaaacagtgtccaggattttaaaatacccagtaatacaacattaaaaactcctctggttgccgtatttgatgatctggatatagaagcggatgaagaagatgaacttagggccagaggtcttacaggtttgaaaaatattggaaatacttgttacatgaatgcagctttgcaggctc

SEQ ID NO: 197343 - DNA, 389 bp, Homo sapiens
  Payload ID: 18927
  Gene Name: ubiquitin specific peptidase 33
  ENST ID: ENST00000524778
  CDS Start-End: 172-389
gaagtggccagttcaggaggcggaccccccgagggcagcgctgcggggccgttttccggccctcctgacgcgacactgcccctctccgagagctgagaaggaaaagaggagcttgcggaggtgttacctcattttgaaagtcttgggaaacaggaaaaaattcctaacaaaatgtcagcttttcgaaatcattgtccacatttggattcagttggtgaaataacaaaagaagatttgatacaaaaatcccttggtacttgtcaggattgtaaagtccaaggaccaaatctttgggcatgtctggagaatagatgttcatatgttggctgtggtgaatcacaagtagatcacagcaccatacattctcaggagacaaagcattatctaac

SEQ ID NO: 197344 - DNA, 11357 bp, Homo sapiens
  Payload ID: 18928
  Gene Name: ubiquitin specific peptidase 34
  Uniprot ID: Q70CQ2
  ENST ID: ENST00000398571
  CDS Start-End: 78-10718
tctctcccctcccccccgccggtcgggatcagtcagtgtgatccgaagcgggggagggggggggcggcggccgaacgatgtgcgagaactgcgcagacctggtggaggtgttaaatgaaatatcagatgtagaaggtggtgatggactgcagctcagaaaggaacatactctcaaaatatttacttatatcaattcctggacacagaggcaatgtctatgctgcttcaaggaatataagcatttggagatttttaatcaagtagtgtgtgcacttattaacttagtgattgcccaagttcaagtgctccgggaccagctttgtaaacattgtactaccattaacatagattccacgtggcaagatgagagtaatcaagcagaagaaccactgaatatagatagagagtgtaatgaaggaagtacagaaagacaaaaatcaatagaaaaaaaatcaaactctacaagaatttgtaatctgactgaggaggaatcttcaaagagttctgatccttttagtttatggagtacagatgagaaggaaaaactcttactatgtgtggcaaaaatttttcaaattcagtttcccttatatactgcttacaagcataatactcaccctactattgaggatatatcaactcaagaaagtaacatattaggggcattctgtgatatgaatgatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatgatcatggtcataatcctcccaaaagcagttgtggtacagatcttcggaatagaaagttagagagtcaagcaggcatttgcctgggggactcccaaggcatgtcagaaagaaatgggacaagcagcggaacaggaaaggacctggtttttaacactgaatcattgccatcagtagataatcgaatgcgaatgctggatgcttgttcacactctgaagacccagaacatgatatttcaggggaaatgaatgctactcatatagcacaagggtctcaggagtcttgtatcacacgaactggggacttccttggggagactattgggaatgaattatttaattgtcgacaatttattggtccacagcatcaccaccaccaccaccaccatcaccaccaccacgatgggcatatggttgatgatatgctaagtgcagatgatgtcagttgtagtagctcccaggttagtgcaaaatcagaaaaaaatatggctgattttgatggtgaagaatctggatgtgaagaggagctagttcagattaattcacatgcggaactgacatctcacctccaacaacatcttcccaatttagcttccatttaccatgaacatcttagtcaaggacctgtagttcataaacatcaattcaacagtaatgctgttacagacattaatttggataatgtttgcaagaaaggaaatactttgttgtgggatatagtccaagatgaagatgcagttaatctttctgaaggattaataaatgaagcagagaaacttctttgttcgttagtatgttggtttacagatagacaaattcgaatgagattcattgaaggttgccttgaaaacttgggaaacaacagatcagtagtaatttcacttcgtcttcttccaaaactatttggtacttttcagcagtttgggagcagttacgatacacactggataacaatgtgggcagaaaaagaactgaacatgatgaagcttttctttgataatttggtatactacattcaaactgtgagagaaggaagacaaaaacatgcactgtacagccatagtgctgaagttcaagttcgtcttcaattcttgacttgtgtattttcaactctgggatcacctgatcatttcaggttaagtttagagcaagttgacatcttatggcattgtttagtagaagattctgaatgttatgatgatgcactccattggtttttaaatcaagttcgaagtaaagatcaacatgctatgggtatggaaacctacaaacatcttttcctggagaagatgccccagctaaaacctgaaacaattagcatgactggcttaaacctgtttcagcatctctgtaacttggctcgattggctaccagtgcctatgatggttgttcaaattctgagctgtgtggtatggaccaattttggggcattgctttaagagcacaatctggtgatgtcagtcgagcagctatccagtatattaactcctattatattaatggtaaaacaggtttggagaaggagcaagaatttattagtaagtgcatggagagtcttatgatagcttctagcagtcttgaacaggaatcacactcaagtctcatggttatagaaagaggactccttatgctgaagacacatctggaagcgtttaggagaaggtttgcatatcatctgagacagtggcaaattgaaggcactggtattagtagtcatttgaaagcactgagtgacaaacagtctctgccgctaagggttgtatgccagccagctggacttcctgacaagatgactattgaaatgtatcctagtgaccaggtagcagatcttagggctgaagtaactcattggtatgaaaatttacagaaagaacaaataaatcaacaagctcagcttcaggagtttggtcaaagcaaccgaaaaggagagtttcctggaggcctcatgggacctgtcaggatgatttcatctggacacgagttaacaacagattatgatgaaaaagcacttcatgagcttggttttaaggatatgcagatggtatttgtatctttgggtgcaccaaggagagagcggaaaggggaaggtgttcagctgccagcatcttgcctcccaccccctcagaaggacaacattccaatgcttttgcttttacaagagcctcatttaactactctttttgatttattagagatgcttgcatcatttaaaccaccctcaggaaaagtggcagtggatgatagtgagagcttacgatgtgaagaacttcatcttcatgcagaaaatctgtctaggcgggtctgggagctactgatgcttcttcctacatgtcctaatatgttgatggcattccagaatatctcagatgagcagagtaatgatggatttaattggaaagaacttctcaaaattaagagcgcccacaagctattgtatgctctggaaattattgaagcactgggaaaacctaatagaagaataaggagggagtctacgggaagttacagtgatctttatccagattcagatgattcaagtgaagatcaagtggaaaatagtaaaaattcctggagttgcaagtttgttgctgctggagggcttcaacagttattagaaatttttaattctggaattctagagcctaaagagcaggaatcatggactgtgtggcagctagactgtcttgcttgcttgctgaagttaatatgccagtttgcagtagatccatccgatttggatttagcttatcatgatgtctttgcctggtctggtatagcggaaagccataggaaaagaacctggcctggcaaatcaaggaaggctgctggtgatcatgctaagggtcttcatataccacgattaacagaggtatttcttgttcttgtccaaggaaccagtttgattcagcgacttatgtctgttgcttatacgtatgataatctggctcctagagttttaaaagctcagtctgatcacaggtctagacatgaagtttcacattattcaatgtggctcttggtgagttgggctcattgctgttctttagtgaaatctagccttgctgatagcgatcatttacaagattggctaaagaaattgactctccttattcctgagactgcagttcgtcatgaatcatgcagtggtctctataagttatccctgtcagggctggatggaggagactcaatcaatcgttcttttctgctattggctgcctcaacattattgaaatttcttcctgatgctcaagcactcaaacctattaggatagatgattatgaggaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtcccatgcaccttataaatgggattactggcctcatgaagatgtccgtgctgaatgtagatttgttggccttactaaccttggagctacttgttacttagcttctactattcagcaactttatatgatacctgaggcaagacaggctgtcttcactgccaagtattcagaggatatgaagcacaagaccactcttctggagcttcagaaaatgtttacatatttaatggagagtgaatgcaaagcatataatcctagacctttctgtaaaacatacaccatggataagcagcctctgaatactggggaacagaaagatatgacagagttttttactgatctaattaccaaaatcgaagaaatgtctcccgaactgaaaaataccgtcaaaagtttatttggaggtgtaattacaaacaatgttgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaatgtctcttggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttca

SEQ ID NO: 197345 - DNA, 1409 bp, Homo sapiens
  Payload ID: 18928
  Gene Name: ubiquitin specific peptidase 34
  ENST ID: ENST00000453133
  CDS Start-End: 1-136
gtgcgagaactgcgcagacctggtggaggtgttaaatgaaatatcagatgtagaaggtggtgatggactgcagctcagaaaggaacatactctcaaaatatttacttatatcaattcctggacacagaggatgtagaagtaccattgcatttgcttcgttatgtatgtttgttttgtgggaaaaatggcctttctctcatgaaggattgctttgaatatggaactcctgaaactttgccatttcttatagcacatgcgtttattacagttgtgtctaatattagaatatggctacatattcccgctgtcatgcagcacattataccttttaggacctatgttattaggtatttatgcaagctctcggatcaggagttacgacagagtgcagctcgtaacatggctgacttaatgtggagcacagtcaaagaaccattggatacaacattatgctttgataaagaaagcctagatcttgcatttaagtactttatgtcacctactttgactatgaggttggctggattgagtcagataacaaatcaactccataccttcaatgatgtgtgcaataatgaatcattagtatcggacacagaaacgtccattgcaaaagaacttgcagactggcttattagcaacaatgtggtggagcatatatttggaccaaatttacatattgagattatcaaacagtgccaagtgattttgaattttttggcagcagaagggcgactgagtactcaacatattgactgtatttgggctgcagcacagttgaaacattgtagtcggtatatacatgacttatttccttcactcatcaagaatttggatcccgtaccacttagacatctacttaatctggtctcagctcttgagccaagtgttcatactgaacagacactgtacttggcatccatgttaattaaagcactgtggaataacgcactagcagctaaggctcagttatctaaacagagttcttttgcatctttattaaatactaatattcccattggaaataagaaagaggaagaagagcttagaagaacagctccatcaccttggtcacctgcagctagtcctcaaagcagtgataatagcgatacacatcaaagtggaggtagtgacattgaaatggatgagcaacttattaatagaaccaaacatgtgcaacaacgactttcagacacagaggaatccatgcagggaagttctgacgaaactgccaacagtggtgaagatggaagcagtggtcctggtagcagtagtgggcatagtgatggatctagcaatgaggttaattctagccacgcaagccagtcagctgggagccctggcagtgaggtacagtcagaagacattgcagatattgaagccctcaaagaggaagatgaagacgatga

SEQ ID NO: 197346 - DNA, 1827 bp, Homo sapiens
  Payload ID: 18928
  Gene Name: ubiquitin specific peptidase 34
  ENST ID: ENST00000436269
  CDS Start-End: 1-1275
gggaaaagcaatattcggcctccgcgccctgaactcaatatgtgcctcttgcccacaatggtggaaaccagtaagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgta

SEQ ID NO: 197347 - DNA, 4309 bp, Homo sapiens
  Payload ID: 18928
  Gene Name: ubiquitin specific peptidase 34
  ENST ID: ENST00000411912
  CDS Start-End: 1-3670
agaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttca

SEQ ID NO: 197348 - DNA, 2708 bp, Homo sapiens
  Payload ID: 18928
  Gene Name: ubiquitin specific peptidase 34
  ENST ID: ENST00000453734
  CDS Start-End: 1-2433
gaagaaccaatattaaaaccaggatgtaaagagtatttttggttgttatgcaaattagttgacaacatacatataaaggacgctagtcagacaacgctcctcgacttagatgccttggcaagacatttggctgactgtattcgaagtagggagatccttgatcatcaggatggtaatgtagaagatgatgggcttacaggactcctaaggcttgcaacaagtgttgttaaacacaaaccaccctttaaattttcaagggaaggacaggaatttttgagagatatcttcaatctcctgtttttgttgccaagtctaaaggaccgacaacagccaaagtgcaaatcacattcttcaagagctgccgcttacgatttgttagtagagatggtaaaggggtctgttgagaactacaggctaatacacaactgggttatggcacaacacatgcagtcccatgcaccttataaatgggattactggcctcatgaagatgtccgtgctgaatgtagatttgttggccttactaaccttggagctacttgttacttagcttctactattcagcaactttatatgatacctgaggcaagacaggctgtcttcactgccaagtattcagaggatatgaagcacaagaccactcttctggagcttcagaaaatgtttacatatttaatggagagtgaatgcaaagcatataatcctagacctttctgtaaaacatacaccatggataagcagcctctgaatactggggaacagaaagatatgacagagttttttactgatctaattaccaaaatcgaagaaatgtctcccgaactgaaaaataccgtcaaaagtttatttggaggtgtaattacaaacaatgttgtatccttggattgtgaacatgttagtcaaactgctgaagagttttatactgtgaggtgccaagtggctgatatgaagaacatttatgaatctcttgatgaagttactataaaagacactttggaaggtgataacatgtatacttgttctcattgtgggaagaaagtacgagctgaaaaaagggcatgttttaagaaattgcctcgcattttgagtttcaatactatgagatacacatttaatatggtcacgatgatgaaagagaaagtgaatacacacttttccttcccattacgtttggacatgacgccctatacagaagattttcttatgggaaagagtgagaggaaagaaggttttaaagaagtcagtgatcattcaaaagactcagagagctatgaatatgacttgataggagtgactgttcacacaggaacggcagatggtggacactattatagctttatcagagatatagtaaatccccatgcttataaaaacaataaatggtatctttttaatgatgctgaggtaaaaccttttgattctgctcaacttgcatctgaatgttttggtggagagatgacgaccaagacctatgattctgttacagataaatttatggacttctcttttgaaaagacacacagtgcatatatgctgttttacaaacgcatggaaccagaggaagaaaatggcagagaatacaaatttgatgtttcgtcagagttactagagtggatttggcatgataacatgcagtttcttcaagacaaaaacatttttgaacatacatattttggatttatgtggcaattgtgtagttgtattcccagtacattaccagatcctaaagctgtgtccttaatgacagcaaagttaagcacttcctttgtcctagagacatttattcattctaaagaaaagcccacgatgcttcagtggattgaactgttgacgaaacagtttaataatagtcaggcagcttgtgagtggtttttagatcgtatggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggtgaaatgtttcgaatttaaaatgtttaaagcatgtttggttttattatttttacataattgtttaccactagtttttccactagctttttattatatatgtttaattatgtaattgttattcactagcttttattatataaatccttttaaataatactactattcatcaactcttgtggcataagaatttcagttttttctaccaaacttttacttcatctatgagtcgtgttagaaatagtcattgaaaaaatatacagtaaaatatctagcaaaa

SEQ ID NO: 197349 - DNA, 4216 bp, Homo sapiens
  Payload ID: 18929
  Gene Name: ubiquitin specific peptidase 35
  Uniprot ID: Q9P2H5
  ENST ID: ENST00000529308
  CDS Start-End: 262-3318
gcttcatcccgcagccccggggccgcgccgcagagtcgggcttcctggatacatagaggcttgtgccaggcggggtgggaagactggattttgcagtggaagcagcatctcttccgtctgggacctggctgagggcgtccccaccctggggggagcagaggaccagccctgacctagccgggcccagcctcgtcctgcccggcctgagcgccccgcccagcagccggctctggcccaccggggtccgggagcgcgggcgccatggacaagatcttggaggcggtggtgacgtcgtcatacccggtcagcgtgaagcaggggctggttcggcgcgtgctggaggcggcgcggcagccgctggagcgtgagcagtgcctggcgctgctggcgctgggcgcgcgcctctacgtgggcggcgcggaggagctgccgcgccgcgtgggctgccagctgctgcacgtggccggccgccaccaccccgacgtcttcgccgagttcttcagcgcgcgtcgcgtgctgcgcctgctgcagggtggcgccggccccccgggcccccgcgcgctcgcctgcgtgcagctgggtctgcagctgctgcccgaggggcctgcggccgacgaggtgttcgcgctgctgcggcgcgaggtgctgcgcaccgtgtgcgagcgcccgggccccgcggcctgcgcgcaggtggcacggctgctggctcgccacccgcgctgtgtgcccgacggaccccaccgcctgctcttctgccagcagctggtgcgttgcctcggccgcttccgctgcccagccgaaggcgaggagggcgccgtggagttcctagagcaggcccagcaggtgagcgggctcctggcgcagctgtggcgcgcacagcccgccgccatcctgccctgcctcaaagagctgttcgcagtcatctcctgcgcagaggaggagccaccatctagcgccctggccagcgtggtccagcacctcccattggagctcatggatggtgttgtccggaacctcagcaatgatgacagtgtgacagactcgcagatgctgactgccattagcaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggttttgggggggggggcggggggctagcttctcacagcaggaggcctttgcccccacagcccctccacgcctgcctcagggcctgagaagccaccacttgtatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcataaataaataaaagtaagcctaagcaaga

SEQ ID NO: 197350 - DNA, 3770 bp, Homo sapiens
  Payload ID: 18929
  Gene Name: ubiquitin specific peptidase 35
  Uniprot ID: Q9P2H5
  ENST ID: ENST00000526425
  CDS Start-End: 627-2876
cagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggcccaggggcagtgcccttccaggcagaagcagctgaaagccttgttctggcattgcagcccagtgtggaggggcgagacttggggtgctgagagggcctggctcccttcttggtgggctgggagcctcagtgtctggcaggtggctgtgctgggcttgtgcatttcccagccatgtctggttcagcccacagaccccggggctgccctttgcaggtgtgagtcaatgtgggaacccaggacattacggatagcccctgggctgccctcaccccagcattttgggtgtcccttgtccctgtgtcactgtcactcccctcaccaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggttttgggggggggggcggggggctagcttctcacagcaggaggcctttgcccccacagcccctccacgcctgcctcagggcctgagaagccaccacttgtatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcataaataaataaaagtaagcctaagc

SEQ ID NO: 197351 - DNA, 2419 bp, Homo sapiens
  Payload ID: 18929
  Gene Name: ubiquitin specific peptidase 35
  ENST ID: ENST00000530267
  CDS Start-End: 446-2206
cggctggccttaaaggggacgcggtcagagtggcagctcgcggggtggcccccgctccggctccgccccatttcacgcacctcgcccctccccatgcttcatcccgcagccccggggccgcgccgcagagtcgggcttcctggatacatagaggcttgtgccaggcggggtgggaagactggattttgcagtggaagcagcatctcttccgtctgggacctggctgagggcgtccccaccctggggggagcagaggaccagccctgacctagccgggcccagcctcgtcctgcccggcctgagcgccccgcccagcagccggctctggcccaccggggtccgggaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacaccc

SEQ ID NO: 197352 - DNA, 1209 bp, Homo sapiens
  Payload ID: 18929
  Gene Name: ubiquitin specific peptidase 35
  ENST ID: ENST00000528910
  CDS Start-End: 315-1209
ccatgcttcatcccgcagccccggggccgcgccgcagagtcgggcttcctggatacatagaggcttgtgccaggcggggtgggaagactggattttgcagtggaagcagcatctcttccgtctgggacctggctgagggcgtccccaccctggggggagcagaggaccagccctgacctagccgggcccagcctcgtcctgcccggcctgagcgccccgcccagcagccggctctggcccaccggggtccgggagaggaggagccaccatctagcgccctggccagcgtggtccagcacctcccattggagctcatggatggtgttgtccggaacctcagcaatgatgacagtgtgacagactcgcagatgctgactgccattagcaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatct

SEQ ID NO: 197353 - DNA, 2986 bp, Homo sapiens
  Payload ID: 18929
  Gene Name: ubiquitin specific peptidase 35
  ENST ID: ENST00000530546
  CDS Start-End: 1-325
cgccgtggagttcctagagcaggcccagcaggtgagcgggctcctggcgcagctgtggcgcgcacagcccgccgccatcctgccctgcctcaaagagctgttcgcagtcatctcctgcgcagaggaggagccaccatctagcgccctggccagcgtggtccagcacctcccattggagctcatggatggtgttgtccggaacctcagcaatgatgacagtgtgacagactcgcagatgctgactgccattagcaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgagtagcttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggttttgggggggggggcggggggctagcttctcacagcaggaggcc

SEQ ID NO: 197354 - DNA, 5234 bp, Homo sapiens
  Payload ID: 18930
  Gene Name: ubiquitin specific peptidase 36
  Uniprot ID: Q9P275
  ENST ID: ENST00000312010
  CDS Start-End: 326-3697
agcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtctcttccacaccagttgccagaggccagtgagcccccccagagcccctctgagaagaggaaaaagacctttgtgggagagccgcagaggctgggctcagagacgcgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaa

SEQ ID NO: 197355 - DNA, 1647 bp, Homo sapiens
  Payload ID: 18930
  Gene Name: ubiquitin specific peptidase 36
  ENST ID: ENST00000449938
  CDS Start-End: 1-1647
atgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccactgccaacgggcatgggctga

SEQ ID NO: 197356 - DNA, 6063 bp, Homo sapiens
  Payload ID: 18930
  Gene Name: ubiquitin specific peptidase 36
  Uniprot ID: Q9P275
  ENST ID: ENST00000542802
  CDS Start-End: 445-3816
gaggcctggggcgcgggaagggctggcgggcgcagccgggacgctcagggagaacgtgggcgcgggtccgcgcagggcttcggccgtccccgaggaggacccgggatgctccgcccgctcgcgagctcgcttctccagagcccgggtattcccgaggagggtccggggccgggctgtcctcgccggtctccgccgtcccccgggctccgggccggtgatgggggtcgccggggcccgctgtctgtgcaggattcaggtcaacttcggagaggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtctcttccacaccagttgccagaggccagtgagcccccccagagcccctctgagaagaggaaaaagacctttgtgggagagccgcagaggctgggctcagagacgcgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtg

SEQ ID NO: 197357 - DNA, 602 bp, Homo sapiens
  Payload ID: 18930
  Gene Name: ubiquitin specific peptidase 36
  ENST ID: ENST00000588130
  CDS Start-End: 1-304
tgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagatgatcaagcggtgctgattcacgagagtggaagcctccagagcttggggctttctggctgctcttcattgacctgtgtgttcccagcacacgaacagtgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttttgaa

SEQ ID NO: 197358 - DNA, 606 bp, Homo sapiens
  Payload ID: 18930
  Gene Name: ubiquitin specific peptidase 36
  ENST ID: ENST00000587379
  CDS Start-End: 1-73
acttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgcgctgggagcctgtcacgaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggatttgacactgttgacctccgcaccctggagagctcctctaagatgtgagcctgttgcatttgctgcatactctagatcaagcccagaatcaactgatccagtcaatacatcccactgaacagccgaccgatccaccctctgtcaggatctctactgtagacactgaaagaggtgccccctcagtataggatcctggcctcaaataatcttctcgcc

SEQ ID NO: 197359 - DNA, 546 bp, Homo sapiens
  Payload ID: 18930
  Gene Name: ubiquitin specific peptidase 36
  ENST ID: ENST00000588365
  CDS Start-End: 389-546
agcgcgggagggctgttgcaggggtgggcaaagtccctcgagtccccgttctggggcgggggcgcgcgccactgtcacacttcaggcgtccgccacgccgccaggtgtgctcggccgacccggaagtagcggcacctctagtgcgctgcggagacgtcaccctgccgcggcacaggggcgggagcgcctgtggctctgcgcacttgcgtcatcacgctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagct

SEQ ID NO: 197360 - DNA, 607 bp, Homo sapiens
  Payload ID: 18930
  Gene Name: ubiquitin specific peptidase 36
  ENST ID: ENST00000587010
  CDS Start-End: 1-215
gtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggagcctcctggagacaaggcgtcccttcccgggagctgtcggtctggatctgagggagctctctgtgtgggctctgctgcgctgggagcctgtcacgatgatcaagcggtgctgattcacgagagtggaagcctccagagcttggggctttctggctgctcttcattgacctgtgtgttcccagcacacgaacagtgcccctaacggagatttgttcagcgactgaatatacacctgtaaacgagtagcatgtatacattgattttgattacaaatggttctgtattatataccaccgttctgactgcttttttcacttatagcttggaaattgtcttctgttggtaatacagaaatctgtttcagtcttttgaa

SEQ ID NO: 197361 - DNA, 2479 bp, Homo sapiens
  Payload ID: 18930
  Gene Name: ubiquitin specific peptidase 36
  ENST ID: ENST00000592231
  CDS Start-End: 1-209
atgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggactaccgtggtttgttctgcagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcagggtatgttccttttcttctcggggtgttgacttgcattcctgtgtgaactgttccctctgccatgtttaccgtgtgatgttctgtagttgaaaatgttagttgtctgctggcacagaatttatctcgttcctttctctcccttctctcctccaaatcagtctcttcccttctccactagataactgtaaaaccttttcctggggtacatacattcgttaactcttgggcagtggtgagcacgagatgactttctgcagcgtttatcactgttgggtggagtcacgtcccttccctccaccgaagtcatcaaccagatagggaagggaaagatgaggcccagaaaacgagttcaaactctaggtcttgtacacgtatgtaagtaaatgtcaataacccaagcctttgtcatagcagtcacttggttgacttaggatctgggtctgttgaattttgtgcttgggaatggagctggagggagtggggcctgtgtacagcagctacctctcccaggtcctctcacttgcctgccccgcgtcctggttgcatggccgcacctgtgtgtgtgcagaggtctgtgtcccatcctctgcacctcctttccgggggcctggggagccccacgtgttgccaagatcttggtgcaataaaatactccggttttgtg

SEQ ID NO: 197362 - DNA, 970 bp, Homo sapiens
  Payload ID: 18930
  Gene Name: ubiquitin specific peptidase 36
  ENST ID: ENST00000589424
  CDS Start-End: 220-924
tcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaaaataaaaattgaatgatcctgtattggtcccccaagtatttcagagctcccggagtctggga

SEQ ID NO: 197363 - DNA, 594 bp, Homo sapiens
  Payload ID: 18930
  Gene Name: ubiquitin specific peptidase 36
  ENST ID: ENST00000592275
  CDS Start-End: 355-594
ctaattccgaagagccatttcctcggcagccccaggctttggccgatcgctcccagatccctccctccccaaactgcaggtgctccgcgtgtgggagtcacggatggccccagagcccgggacgttaaggccgagcgcccgcgcctccgcttctccacagccacctgacggccaggggcaggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccg

SEQ ID NO: 197364 - DNA, 960 bp, Homo sapiens
  Payload ID: 18930
  Gene Name: ubiquitin specific peptidase 36
  ENST ID: ENST00000586066
  CDS Start-End: 184-960
cattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaaaataaaaattgaatgatcctgtattggtcccccaagtatttcagagctcccggagtctgggaagtgccatggttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaag

SEQ ID NO: 197365 - DNA, 5885 bp, Homo sapiens
  Payload ID: 18930
  Gene Name: ubiquitin specific peptidase 36
  Uniprot ID: Q9P275
  ENST ID: ENST00000589225
  CDS Start-End: 219-3590
cgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtctcttccacaccagttgccagaggccagtgagcccccccagagcccctctgagaagaggaaaaagacctttgtgggagagccgcagaggctgggctcagagacgcgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgcgctgggagcctgtcacggtaggagctctcccggtaccagtgtccacagaccgcccaacacagaggctttgaggcttctctagatcggaacctctttggtgacattcccgaccagccctgcaagagaaacgacagtgtgtgtgtgagcagaggtggccgcacacctgctggacatctttgccaggctgtgccttctcatgtttcatagacagtggtctgtgctggcagaggctgctgcccctggttggggctatcaggagagtgggggatggtggccacatgtcccccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcaggatgatcaagcggtgctgattcacgagagtggaagcctccagagcttggggctttctggctgctcttcattgacctgtgtgttcccagcacacgaacagtgcccctaacggagatttgttcagcgactgaatatacacctgtaaacgagtagcatgtatacattgattttgattacaaatggttctgtattat

SEQ ID NO: 197366 - DNA, 898 bp, Homo sapiens
  Payload ID: 18930
  Gene Name: ubiquitin specific peptidase 36
  ENST ID: ENST00000586531
  CDS Start-End: 362-898
cggtgcgcaggcctggggacgagaccggggcggggggttccgcgaggcctggggcgcgggaagggctggcgggcgcagccgggacgctcagggagaacgtgggcgcgggtccgcgcagggcttcggccgtccccgaggaggacccgggatgctccgcccgctcgcgagctcgcttctccagagcccgggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgcc

SEQ ID NO: 197367 - DNA, 1771 bp, Homo sapiens
  Payload ID: 18930
  Gene Name: ubiquitin specific peptidase 36
  ENST ID: ENST00000590546
  CDS Start-End: 311-1168
ctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagtgcgtgcttccccacccaccctcccagggctttggacaccttttctacatggtggcagcagaacattcctatggcaacagccagcccggcacctttctacccaggctgcccttgggtagacgtggcagaatttgcctctgggtactcaaactgttggagcccaaataggggattgcccttgcttcctgggaaagggctgtctccggagacgtcctgctggtccggggcggcttggtaggatcgggtggctgtggtggcggcagctgtgtctgagcagctcagtcagggggaaatatgttagcagaccttcttaggggcattcagttcttaccatggactttttcagtctcttaaaaatcatgtcgtttttgaaaagaggttggggtggtaggaatgaggtctctgcagtataatttatatgtacatgtatatgtacaaacagggagctttaacatgaggaggtttataactttaggatctgactgtgcctggctgctgtttcttattcacacgccacgtaagcccttatatgtgatggttgccatcacaaattgtctttgtgtcattcctgagttcataggttcagaccaaagaaaacaggcaggaaatgcttaggacttccttgtattgcctcagcttaggatcgtagaaatactttaaatagtttagggaatatacctagaatgttctttagagaagttgagttgtggcaataagtgattgaaatggcaaaactactggcctcagtggatgatattcttacgtaaataa

SEQ ID NO: 197368 - DNA, 696 bp, Homo sapiens
  Payload ID: 18930
  Gene Name: ubiquitin specific peptidase 36
  ENST ID: ENST00000586896
  CDS Start-End: 218-696
aggaagagtcgcctccactgatggtctccctgtccctcccacaggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgcca

SEQ ID NO: 197369 - DNA, 679 bp, Homo sapiens
  Payload ID: 18930
  Gene Name: ubiquitin specific peptidase 36
  ENST ID: ENST00000587783
  CDS Start-End: 480-679
tggcgggcgcagccgggacgctcagggagaacgtgggcgcgggtccgcgcagggcttcggccgtccccgaggaggacccgggatgctccgcccgctcgcgagctcgcttctccagagcccgggtattcccgaggagggtccggggccgggctgtcctcgccggtctccgccgtcccccgggctccgggccggtgatgggggtcgccggggcccgctgtctgtgcaggattcaggtcaacttcggagaggttgaagtcggaatcagggcgagggcgtcgcgtgcggccgcagagctcagcggggcgggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaac

SEQ ID NO: 197370 - DNA, 427 bp, Homo sapiens
  Payload ID: 18930
  Gene Name: ubiquitin specific peptidase 36
  ENST ID: ENST00000591052
  CDS Start-End: 1-36
ccagcaaaggctgccagcctcagctatcgccgctgactgtgcccctgtggaaggagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcaggatgatcaagcggtgctgattcacgagagtggaagcctccagagcttggggctttctggctgctcttcattgacctgtgtgttcccagcacacgaacagtgcccctaacggagatttgttcagcgactgaatatacacctgtaaacgagtagcatgtatacattgattttgattacaaatggttctgtattata

SEQ ID NO: 197371 - DNA, 3187 bp, Homo sapiens
  Payload ID: 18930
  Gene Name: ubiquitin specific peptidase 36
  ENST ID: ENST00000588086
  CDS Start-End: 303-3187
ggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgctttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtctcttccacaccagttgccagaggccagtgagcccccccagagcccctctgagaagaggaaaaagacctttgtgggagagccgcagaggctgggctcagagacgcgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaagaaaaaaagaaa

SEQ ID NO: 197372 - DNA, 564 bp, Homo sapiens
  Payload ID: 18930
  Gene Name: ubiquitin specific peptidase 36
  ENST ID: ENST00000591942
  CDS Start-End: 225-410
aggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagctt

SEQ ID NO: 197373 - DNA, 8032 bp, Homo sapiens
  Payload ID: 18931
  Gene Name: ubiquitin specific peptidase 37
  Uniprot ID: Q86T82
  ENST ID: ENST00000258399
  CDS Start-End: 414-3353
gtgcgtgcgtgtttgcgtgtggtcacagttcccgccatcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacgaaaacaaaaacaaaaaaaacacaaaccatcatcacagaagatgcaacatcttttctgaaagattgccttaagagagctccagtcctactcttggaacttggatgtattctaatgtagtaaactattctaagttttcattctttgaattataaatggcctcagcagttttgctcaactactgataaatgctttgcctcctaccatctacctatataccttattgtaatgaatgttccaaaatggtagagtggtagaaaacgccagagtagtttagagcagaggaaaatatttgttttaaaactagctttaaagttttgtttcatttctaccaggagcctctttggtttggtttgattttgcttggaaataattggttttcttataaatgagtgaagcggtgataaaattctttggctagttattaattcttttacgtgtctttgcatttgagaggcactgttaaaaattattgggaaagatttaaagtgcaggctgcaattaaaacatggagaaaagtagaaataatgccataagtctagattgcctcatgaagcagcctcatttgaattgctttcatagctttcatgtgtgtatggtttagaagtacacttacctcagaaacctgatttgatcttcatgtcttgggcaggagttgttgaaaataggttattggaatatataagttatctcactgctcatgtacttgcatgtttgggactcaaattttacttgatgtctgtccattcttgtggccctatcagccttctccttcctttactcctttaatctacttctttgactaccagtggagatttcagctggactatgttgatggggtttgttgttgtttttgagctggctgtatatattttaaaattataaatagataatatattattttttgcacattgtgatcagtttgcccagaattggggatggggcagttagcatgttggggccaggaagggacaagttagataaggactgagtgcttccgttgcaggcagtttgcacaatacctaattaaccttcctattgaaaataccaaatgtgtggttacattactttaaatgacattgaattggaacttgatggcaattagttctagatacaaccttttgatctttgttggaattttaagggaaaaatgaactaaacttcatatttgttgattttaatcacctaatagtactgaaggttggaaagttgcatgtggctggatgctgttaatttctttaatagccatgactataatttaagcctatgagaagatagactgtttcgtagggatatattcacatgtgtgtgcacactcatgagttttgtctcagcaggatagaataagcaaatccatgaactggtcttctattaatactttgattctaaaaattatttgtttacttgctatggtctgttcattctgggcctaaccttaaaggctcaataacaaatacaacaaatgtaaatatgtttacattttaagacatatgcagtggttcttacagatcagttaattaactccagaaagcaaatgttagactacacatttatttttctccttgatcaagtataaaattctgaaacagaggctttaaaatttaaaacctcagcaaaataatccatgaatttactgattcttctgtatcgtgtgtagttaccattatgtaactatacacacatacagctacggatataatgaaaattatctgcaaacacctaaattaaagagaaaaaaaagtagtttgtaaactcatttgtgatctactgaaaagaggttatattaaagcaaattaaaatattttccttctctgtcctctgaaatgactgcagtagatactcttagttatcccatttagggtggttggagggcctttttaatttaattgaccccccgaggtggtcttttgttttaaacagggggcaacagctggatctccaagtacatatggattttgtatatataggagatttttagaaaaatcaacaacctaacaccagattcaagtcacataaaagtgttccaataaaatggatggatgtctttttcctccccattttgctttatactgagtaatgcactcttgcaagtgtatacaaaaactaaatagacttctgccctccaacatctttttattgcattacttcaaaatcctaattttgtctctactgatatgtcttattaacatctgaaaaaatatatattttttattggaaaattctaatttgttaggccttgaaagttttgtgacaattattttgctgtgtttaaccacaatcattcaccttatggcatgctttgattactagacttcaggcagtctcattcattgtatcatacttacacacaattagtaagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcagatgccagaacaaagaagaacagtcaactaaactggtctacttcaaaaatagtgggcctgtgtgaagagtgagaccacatgtgggtgtgcacacctcttgtccccaggtttccctccctttgagcttttctttccctccctaacttctctggcctattgtcattgttgtttctttaaacttaaggagagaaaaacaaaaatgagattcctacactttgcctaattgagccactaccaggttttctggcagctgtggccacattatttgtgagatgattttttttctttatgttcagagtgacttttgattctgattctttatgttttgtatggagcggcacttttatctgtgttttagcagaactgttcctctgtatcctttacggtttttctttgtttttgtttcctttttaaattatgcatagagtttttttgtgtgtatgaaattaaagcctttattaaccttc

SEQ ID NO: 197374 - DNA, 1771 bp, Homo sapiens
  Payload ID: 18931
  Gene Name: ubiquitin specific peptidase 37
  ENST ID: ENST00000338465
  CDS Start-End: 379-1287
catcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacagatttattgggtataaatacataagatacctgctaagcacttgttgagaacatgtgatcatgcagtgcagcacagaagggttgatggttttaaatgtaaaaagtgagggtaatggcaaatgcccatcaatgatagacaggataaagaaaatgtggcatatatataccatggaatactatgcagccataaaaatggatgagttcatgtcctttgcagagacatggatgaagctgaaaaccatcattctcagcaaactgacacaggaacataaaaccaaacaccacatattcttactcataagtggatgttgaacaatgagaacacatggacacagggaggggaacatcactcaccggggtctgtcgtggggtggggggctaggggagggatagcattaagagaaatacctaatgtagatgatgggttgatgggtgcagcaaaccatgatggcatgtgtatacctatgtaacaaacctgcacattgtacacatgtatcccagaacttaaaatataattaaaaaaaaaaagtga

SEQ ID NO: 197375 - DNA, 5019 bp, Homo sapiens
  Payload ID: 18931
  Gene Name: ubiquitin specific peptidase 37
  Uniprot ID: Q86T82
  ENST ID: ENST00000454775
  CDS Start-End: 418-3357
atcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagaacctgccaggtaaaggtatatttttgctttttaatttagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccatcattatattctttcgtgttttttcttttattataaacaaggggattattctttagttctcagaggtagggacaaaaccacatcaggttttcagaaggaaaaaacatttaaaaacccaccatcacatgagagaatcacttgaacccaggaggcagaggttgcagtgagctgagatcgcatcattgcactgcagtctgagtgacagagtgagactccatctcattaaaaaaaacg

SEQ ID NO: 197376 - DNA, 3353 bp, Homo sapiens
  Payload ID: 18931
  Gene Name: ubiquitin specific peptidase 37
  Uniprot ID: Q86T82
  ENST ID: ENST00000418019
  CDS Start-End: 299-3238
gcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaagttatttgccatacagtaaccagagacctccaactaggggcccccaaactgtatcctgcctgtagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatttctagaccattgaaagcctctcaaatggtgaattcctgcatcaccagcccttctacaccttcaaagaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacag

SEQ ID NO: 197377 - DNA, 4516 bp, Homo sapiens
  Payload ID: 18931
  Gene Name: ubiquitin specific peptidase 37
  Uniprot ID: Q86T82
  ENST ID: ENST00000415516
  CDS Start-End: 430-3087
ggtcacagttcccgccatcagccgctctccctgactaggggtagctagcggcctccctcctttgggttcggtatccctacttccattaccctcggctcctcccactcctcgcgggctccgtgctttccgcgggtctgtccgggggctccggaccctcggcgcagctgagttgatggcttccggagaactggcatagctgcagaatatgagtagtgtcccaagaagagtgctttgcctttggcacaaggatcagaataaaggtgaattgctattacatagggtttttcggtaaaagtcactgaaaattatttgccatacagtaaccagagacctccaactaggggcccccaaactgtatcctgcctgtagctaagtcataacattaaaaatgtggtgcttcgacccagtggagcgaaacaaagccgcctaatgttaactctgcaagataacagcttcttgtctattgacaaagtaccaagtaaggatgcagaggaaatgaggttgtttctagatgcagtccatcaaaacagacttcctgcagccatgaaaccgtctcaggggtctggtagttttggagccattctgggcagcaggacctcacagaaggaaaccagcaggcagctttcttactcagacaatcaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcgtactgaaaagaggaaaagaatgatatcaactggctcagaattgaatgaagattaccctaaggaaaatgattcatcatcgaacaacaaggccatgacagatccctccagaaagtatttaaccagcagtagagaaaagcagctgagtttgaaacagtcagaagagaataggacatcagggcttttacctttacagtcatcatccttttatggtagcagagctggatccaaggaacactcttctggtggcactaacttagacaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcagggcttctccaatttgggaaatacctgctatatgaatgctattctacaatctctattttcactccagtcatttgcaaatgacttgcttaaacaaggtatcccatggaagaaaattccactcaatgcacttatcagacgctttgcacacttgcttgttaaaaaagatatctgtaattcagagaccaaaaaggatttactcaagaaggttaaaaatgccatttcagctacagcagagagattctctggttatatgcagaatgatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcatgtggagagattatccccaaaagagaacagtttaatgacctctctattgaccttcctcgtaggaaaaaaccactccctcctcgttcaattcaagattctcttgatcttttctttagggccgaagaactggagtattcttgtgagaagtgtggtgggaagtgtgctcttgtcaggcacaaatttaacaggcttcctagggtcctcattctccatttgaaacgatatagcttcaatgtggctctctcgcttaacaataagattgggcagcaagtcatcattccaagatacctgaccctgtcatctcattgcactgaaaatacaaaaccaccttttacccttggttggagtgcacatatggcaatgaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctggatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagaggcttgggaacagaaagaagatgatgacctcaaaagagctaccgagttaagtcttcaagagtttaacaactcctttgtggatgcattgggttctgatgaggactctggaaatgaggatgtttttgatatggagtacacagaagctgaagctgaggaactgaaaagaaatgctgagacaggaaatctgcctcattcgtaccggctcatcagtgttgtcagtcacattggtagcacttcttcttcaggtcattacattagtgatgtatatgacattaagaagcaagcgtggtttacttacaatgacctggaggtatcaaaaatccaagaggctgccgtgcagagtgatcgagatcggagtggctacatcttcttttatatgcacaaggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttgggcatttaaccatttactgtctggctttgcccttaaaatagggttgcaattaaaatgtgattggcttaggtaatcccaaaaactaacaaataacaaaggtgcataatttatttatctactttttaggtgctctgagttgaggcaaagtagagcggcaacattaagtgctatgctagtcacttagctgacgtaaccagcttggttaagcagcttatgaaaccatataaagaattcttttgaggatggaattctgtccacaaaataattttgtgagcccagatatcattaggatcacacagagttaaatatagaaaaatgaaaccat

SEQ ID NO: 197378 - DNA, 7009 bp, Homo sapiens
  Payload ID: 18932
  Gene Name: ubiquitin specific peptidase 38
  Uniprot ID: Q8NB14
  ENST ID: ENST00000307017
  CDS Start-End: 507-3635
cttcggtctcttctccccggctgatcccagcactctccgtgacagcgcctcctgactcagcccaggaccggcttcttctcacgacctgctggagactggacgcccacacctgacccggaactcggaggcgtgcttcctccacccgccggctagcagccccgggccctgagctcccgccgacgccgctggggggcccgacaggcccctcggcgctgatgctgagtgggatcgagggcccggggcggcggcggagtacgggcctctggcgccttaggccagccgcaggtgtcggttcttaggctctccaggctcgctagctcccgccccggcttggatgggtctccctgcgccataaatgtggctgctgaggcggcggtggccgtggcccgtcgcgctgctgctgcggcgctccaagttcatctccgccccggggctctcctgccccacctcggggctgccgccacccgctccttatcccctggccctggccttgcagcgtggcgacaatggacaagatcctggagggccttgtgagttcctcgcatcccctgcccctcaagcgggtgattgtgcggaaggtggtggaatcggcggagcactggctagacgaggcgcagtgcgaggccatgtttgacctgacgacccggctcatcctggagggccaggaccctttccagcggcaggtggggcaccaggtgctggaggcctacgcacgataccaccggccagagttcgagtccttcttcaacaagaccttcgtgttgggcctccttcatcagggctaccactctctggacaggaaggatgtagccatcctggactacattcacaacggcctgaagctgattatgagctgtccgtcggtgctggatctctttagcctcctgcaggtagaggtgttacggatggtgtgtgagaggccggagccgcagctctgtgcccgactgagcgaccttctgaccgactttgtgcaatgcatccccaaggggaaattgtccatcacgttctgtcaacagctggttcgaacgataggccatttccagtgcgtgtccacccaggaaagagagctgcgggaatatgtctcccaggtgacaaaagtgagtaacttgctgcagaacatctggaaggccgagcctgccacactactgccttccctgcaagaagtttttgcaagcatctcttccacagatgcatcatttgaaccttctgtagcattggcaagccttgtgcagcatattcctcttcagatgattacagttctcatcaggagccttactacggatccaaatgtaaaagatgcaagtatgacccaagccctttgcagaatgattgactggctatcctggccattggctcagcatgtggatacatgggtaattgcactcctgaaaggactggcagctgtccagaagtttactattttgatagatgttactttgctgaaaatagaactggtttttaatcgactttggtttcctcttgtgagacctggtgctcttgcagttctttctcacatgctgcttagctttcagcattctccagaggcgttccatttgattgttcctcatgtggttaatttggttcattctttcaaaaatgatggtctgccttcaagtacagccttcttagtacaattaacagaattgatacactgtatgatgtatcattattctggatttccagatctctatgaacctattctggaggcaataaaggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagatttcaggagacaagtattatctttaaatctaaatgggtgcaattcattaatgaaaaaattacagcatctttttgcctttctggcccatacacagagggaagcatacgcacctcggatattctttgaggcttccagacctccatggtttactcccagatcacagcaagactgttctgaatacctcagatttctccttgacaggctccatgaagaagaaaagatcttgaaagttcaggcctcacacaagccttctgaaattctggaatgcagtgaaacttctttacaggaagtagctagtaaagcagcagtactaacagagacccctcgtacaagtgacggtgagaagactttaatagaaaaaatgtttggaggaaaactacgaactcacatacgttgtttgaactgcaggagtacctcacaaaaagtggaagcctttacagatctttcgcttgccttttgtccttcctcttctttggaaaacatgtctgtccaagatccagcatcatcacccagtatacaagatggtggtctaatgcaagcctctgtacccggtccttcagaagaaccagtagtttataatccaacaacagctgccttcatctgtgactcacttgtgaatgaaaaaaccataggcagtcctcctaatgagttttactgttctgaaaacacttctgtccctaacgaatctaacaagattcttgttaataaagatgtacctcagaaaccaggaggtgaaaccacaccttcagtaactgacttactaaattattttttggctccagagattcttactggtgataaccaatattattgtgaaaactgtgcctctctgcaaaatgctgagaaaactatgcaaatcacggaggaacctgaataccttattcttactctcctgagattttcatatgatcagaagtatcatgtgagaaggaaaattttagacaatgtatcactgccactggttttggagttgccagttaaaagaattacttctttctcttcattgtcagaaagttggtctgtagatgttgacttcactgatcttagtgagaaccttgctaaaaaattaaagccttcagggactgatgaagcttcctgcacaaaattggtgccctatctattaagttccgttgtggttcactctggtatatcctctgaaagtgggcattactattcttatgccaggaatatcacaagtacagactcttcatatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatggtttaagtggtaataacccaaccagtggactctggataaatggagacccacctctacagaaagaacttatggatgctataacaaaagacaataaactatatttacaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagattttccagaagtaaaatctgatggttctaaatcaatcaatgtgatagttcatttttaactcttagaagaattcagaggaaattaacccagctaagtaaaaaatctgtcttgattttgttacttattcctcagaatattaaacattgatcacatatttttagagttttacatttgggttttttgtttgtttgtttcagtcatatgtttggcactgttgtttctattttcgtagttttagataaaatgttaaaatgccaaaccctaccttcctacactttttcttttgccaggaaactggaaacatgtcagttctcctggttcttgattatacagtactcaagagttatcccagttatcccccttcctaaaggttttaacttatccacagttgtgcattgttctgaagattggtctcatatttattttgaaaacactttaaggaaacaatgttcttcgatgatttggggtttatctttttcccaagcttttatgacagtggttaaaaaacagaaatcctcatgtttattccattacctcccattcctaacctgtttccaatcaccaggaagattaggaaggcagattagattaaaaactgaaaattctttgcagatttaatgaaggttctcctccttataaatgaatgaaccagttatcatgcttttctgtggttttcctatcccaatagtgaatttctgagctatcctgtgtgttcagttatccacttacttgatagcaacttacgaccagattatatcagtcttggcatttattgaaattggtaaagtgatttaatacttgatagattgatattgggctaagatgcttctaggaactttcataaaagcaattatacttgtgcagctttatctatgaatatcaggtctctcaaggattttatgtatcaagataatatgtattgacttttttaaatgataaaatgaattctagttagagtctttccttggtatctgcagtggattggttccagaacaccatcccccaatattaaaatccacagatactcaagtcccttatttatataaaatagcacagtatttgcatataacctgtgcacatcctcccatatactttaatctccagatgattagatatgattgcatagcacttacgttgtgctatgtagttgttatattgttttttcatttgtactattttttatgatatttattggttttttaaattttctatccaaagttgtttgaatctaaggatacagagcctgaggatatggaaagctgactaaatatagtaacactgaagagtattcaaatgataactcataccagtaccaaaaacttgaagacttccttttaacattaaaaatacagtaactttttacgtgatttgttgaattcaacatatttggaaccagaataatcagaaacttcattcaaaacctatgcatctgaacttttttagtaaggtaatactcaggactgttctgattctaacagatccctgttaattacagatttatttgtcatattaggtcttttctttctcccatattcctaacccgtgtactagctccaactgttgtgaggtttgactctgaagactgagtagagtactattgttgtttttctttccttagtcagagtaatcagtttaaatgaagttgctcattgctgctaagaagcattaggcttcactgctagcaaaaatgaaaaactacaaatctgagtctttctttcaaagatgtttattgacataattaaagtaaaaaattgtttagagatatgcaaagaaggaaatatatatgatgtcacacaagctccagtaagctatccactaagcaggtgcctgtgcaactctgatttatggcattaacatatcaaattgaaggaaggattctagctcattttccattcaagcatcttcccactgcctctcttccagctaaataatcagagaagcagggcagtatatccctggagatccctgacttttatctccataccttaaattgttggtagatcctttggatgtagagataaaaattcattatgatgctagaggcattggggggtccatgcgaaaggttcaaacagcctattacattaatgcacatgtggaaagaacaaaaattttcaagctaagtcttaagttcaaatctataatttttttctcttcagttctgttctttgtatgataatccttaaaaaagtagttgtcttcttttcacatacacctctttaaagctatcatcttataataagtggaattggatgcttattgtgtgcccagcacagtttaggaaaaaaataattggcactgtttgtccagttactggagatcttcattttgatgctttgtactttgttccaggtctttaattctcagtccatcttttcctatgattgtgtacttcacatgatacattccatataaagagctcttttaaaatgactatttcaaaaatactgtacatttatatatagtattttttctcataaaaatgtgatagtttata

SEQ ID NO: 197379 - DNA, 6376 bp, Homo sapiens
  Payload ID: 18932
  Gene Name: ubiquitin specific peptidase 38
  ENST ID: ENST00000511739
  CDS Start-End: 1-1044
aagaccttcgtgttgggcctccttcatcagggctaccactctctggacaggaaggatgtagccatcctggactacattcacaacggcctgaagctgattatgagctgtccgtcggtgctggatctctttagcctcctgcaggtagaggtgttacggatggtgtgtgagaggccggagccgcagctctgtgcccgactgagcgaccttctgaccgactttgtgcaatgcatccccaaggggaaattgtccatcacgttctgtcaacagctggttcgaacgataggccatttccagtgcgtgtccacccaggaaagagagctgcgggaatatgtctcccaggtgacaaaagtgagtaacttgctgcagaacatctggaaggccgagcctgccacactactgccttccctgcaagaagtttttgcaagcatctcttccacagatgcatcatttgaaccttctgtagcattggcaagccttgtgcagcatattcctcttcagatgattacagttctcatcaggagccttactacggatccaaatgtaaaagatgcaagtatgacccaagccctttgcagaatgattgactggctatcctggccattggctcagcatgtggatacatgggtaattgcactcctgaaaggactggcagctgtccagaagtttactattttgatagatgttactttgctgaaaatagaactggtttttaatcgactttggtttcctcttgtgagacctggtgctcttgcagttctttctcacatgctgcttagctttcagcattctccagaggcgttccatttgattgttcctcatgtggttaatttggttcattctttcaaaaatgatggtctgccttcaagtacagccttcttagtacaattaacagaattgatacactgtatgatgtatcattattctggatttccagatctctatgaacctattctggaggcaataaagtcttgctctgttgcccaggctgaagtgcaatggcatgatcacggctcactgcagcctctacatcttgagctcaagtgaccctcctgcctcagcctcccaagtagctgggactccaggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagatttcaggagacaagtattatctttaaatctaaatgggtgcaattcattaatgaaaaaattacagcatctttttgcctttctggcccatacacagagggaagcatacgcacctcggatattctttgaggcttccagacctccatggtttactcccagatcacagcaagactgttctgaatacctcagatttctccttgacaggctccatgaagaagaaaagatcttgaaagttcaggcctcacacaagccttctgaaattctggaatgcagtgaaacttctttacaggaagtagctagtaaagcagcagtactaacagagacccctcgtacaagtgacggtgagaagactttaatagaaaaaatgtttggaggaaaactacgaactcacatacgttgtttgaactgcaggagtacctcacaaaaagtggaagcctttacagatctttcgcttgccttttgtccttcctcttctttggaaaacatgtctgtccaagatccagcatcatcacccagtatacaagatggtggtctaatgcaagcctctgtacccggtccttcagaagaaccagtagtttataatccaacaacagctgccttcatctgtgactcacttgtgaatgaaaaaaccataggcagtcctcctaatgagttttactgttctgaaaacacttctgtccctaacgaatctaacaagattcttgttaataaagatgtacctcagaaaccaggaggtgaaaccacaccttcagtaactgacttactaaattattttttggctccagagattcttactggtgataaccaatattattgtgaaaactgtgcctctctgcaaaatgctgagaaaactatgcaaatcacggaggaacctgaataccttattcttactctcctgagattttcatatgatcagaagtatcatgtgagaaggaaaattttagacaatgtatcactgccactggttttggagttgccagttaaaagaattacttctttctcttcattgtcagaaagttggtctgtagatgttgacttcactgatcttagtgagaaccttgctaaaaaattaaagccttcagggactgatgaagcttcctgcacaaaattggtgccctatctattaagttccgttgtggttcactctggtatatcctctgaaagtgggcattactattcttatgccaggaatatcacaagtacagactcttcatatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatggtttaagtggtaataacccaaccagtggactctggataaatggagacccacctctacagaaagaacttatggatgctataacaaaagacaataaactatatttacaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagattttccagaagtaaaatctgatggttctaaatcaatcaatgtgatagttcatttttaactcttagaagaattcagaggaaattaacccagctaagtaaaaaatctgtcttgattttgttacttattcctcagaatattaaacattgatcacatatttttagagttttacatttgggttttttgtttgtttgtttcagtcatatgtttggcactgttgtttctattttcgtagttttagataaaatgttaaaatgccaaaccctaccttcctacactttttcttttgccaggaaactggaaacatgtcagttctcctggttcttgattatacagtactcaagagttatcccagttatcccccttcctaaaggttttaacttatccacagttgtgcattgttctgaagattggtctcatatttattttgaaaacactttaaggaaacaatgttcttcgatgatttggggtttatctttttcccaagcttttatgacagtggttaaaaaacagaaatcctcatgtttattccattacctcccattcctaacctgtttccaatcaccaggaagattaggaaggcagattagattaaaaactgaaaattctttgcagatttaatgaaggttctcctccttataaatgaatgaaccagttatcatgcttttctgtggttttcctatcccaatagtgaatttctgagctatcctgtgtgttcagttatccacttacttgatagcaacttacgaccagattatatcagtcttggcatttattgaaattggtaaagtgatttaatacttgatagattgatattgggctaagatgcttctaggaactttcataaaagcaattatacttgtgcagctttatctatgaatatcaggtctctcaaggattttatgtatcaagataatatgtattgacttttttaaatgataaaatgaattctagttagagtctttccttggtatctgcagtggattggttccagaacaccatcccccaatattaaaatccacagatactcaagtcccttatttatataaaatagcacagtatttgcatataacctgtgcacatcctcccatatactttaatctccagatgattagatatgattgcatagcacttacgttgtgctatgtagttgttatattgttttttcatttgtactattttttatgatatttattggttttttaaattttctatccaaagttgtttgaatctaaggatacagagcctgaggatatggaaagctgactaaatatagtaacactgaagagtattcaaatgataactcataccagtaccaaaaacttgaagacttccttttaacattaaaaatacagtaactttttacgtgatttgttgaattcaacatatttggaaccagaataatcagaaacttcattcaaaacctatgcatctgaacttttttagtaaggtaatactcaggactgttctgattctaacagatccctgttaattacagatttatttgtcatattaggtcttttctttctcccatattcctaacccgtgtactagctccaactgttgtgaggtttgactctgaagactgagtagagtactattgttgtttttctttccttagtcagagtaatcagtttaaatgaagttgctcattgctgctaagaagcattaggcttcactgctagcaaaaatgaaaaactacaaatctgagtctttctttcaaagatgtttattgacataattaaagtaaaaaattgtttagagatatgcaaagaaggaaatatatatgatgtcacacaagctccagtaagctatccactaagcaggtgcctgtgcaactctgatttatggcattaacatatcaaattgaaggaaggattctagctcattttccattcaagcatcttcccactgcctctcttccagctaaataatcagagaagcagggcagtatatccctggagatccctgacttttatctccataccttaaattgttggtagatcctttggatgtagagataaaaattcattatgatgctagaggcattggggggtccatgcgaaaggttcaaacagcctattacattaatgcacatgtggaaagaacaaaaattttcaagctaagtcttaagttcaaatctataatttttttctcttcagttctgttctttgtatgataatccttaaaaaagtagttgtcttcttttcacatacacctctttaaagctatcatcttataataagtggaattggatgcttattgtgtgcccagcacagtttaggaaaaaaataattggcactgtttgtccagttactggagatcttcattttgatgctttgtactttgttccaggtctttaattctcagtccatcttttcctatgattgtgtacttcacatgatacattccatataaagagctcttttaaaatgactatttcaaaaatactgtacatttatatatagtattttttctcataaaaatgtgatagtttata

SEQ ID NO: 197380 - DNA, 4135 bp, Homo sapiens
  Payload ID: 18932
  Gene Name: ubiquitin specific peptidase 38
  Uniprot ID: Q8NB14
  ENST ID: ENST00000510377
  CDS Start-End: 535-3549
acttcaaaatccgggtcaaagggtgtcgcttcggtctcttctccccggctgatcccagcactctccgtgacagcgcctcctgactcagcccaggaccggcttcttctcacgacctgctggagactggacgcccacacctgacccggaactcggaggcgtgcttcctccacccgccggctagcagccccgggccctgagctcccgccgacgccgctggggggcccgacaggcccctcggcgctgatgctgagtgggatcgagggcccggggcggcggcggagtacgggcctctggcgccttaggccagccgcaggtgtcggttcttaggctctccaggctcgctagctcccgccccggcttggatgggtctccctgcgccataaatgtggctgctgaggcggcggtggccgtggcccgtcgcgctgctgctgcggcgctccaagttcatctccgccccggggctctcctgccccacctcggggctgccgccacccgctccttatcccctggccctggccttgcagcgtggcgacaatggacaagatcctggagggccttgtgagttcctcgcatcccctgcccctcaagcgggtgattgtgcggaaggtggtggaatcggcggagcactggctagacgaggcgcagtgcgaggccatgtttgacctgacgacccggctcatcctggagggccaggaccctttccagcggcaggtggggcaccaggtgctggaggcctacgcacgataccaccggccagagttcgagtccttcttcaacaagaccttcgtgttgggcctccttcatcagggctaccactctctggacaggaaggatgtagccatcctggactacattcacaacggcctgaagctgattatgagctgtccgtcggtgctggatctctttagcctcctgcaggtagaggtgttacggatggtgtgtgagaggccggagccgcagctctgtgcccgactgagcgaccttctgaccgactttgtgcaatgcatccccaaggggaaattgtccatcacgttctgtcaacagctggttcgaacgataggccatttccagtgcgtgtccacccaggaaagagagctgcgggaatatgtctcccaggtgacaaaagtgagtaacttgctgcagaacatctggaaggccgagcctgccacactactgccttccctgcaagaagtttttgcaagcatctcttccacagatgcatcatttgaaccttctgtagcattggcaagccttgtgcagcatattcctcttcagatgattacagttctcatcaggagccttactacggatccaaatgtaaaagatgcaagtatgacccaagccctttgcagaatgattgactggctatcctggccattggctcagcatgtggatacatgggtaattgcactcctgaaaggactggcagctgtccagaagtttactattttgatagatgttactttgctgaaaatagaactggtttttaatcgactttggtttcctcttgtgagacctggtgctcttgcagttctttctcacatgctgcttagctttcagcattctccagaggcgttccatttgattgttcctcatgtggttaatttggttcattctttcaaaaatgatggtctgccttcaagtacagccttcttagtacaattaacagaattgatacactgtatgatgtatcattattctggatttccagatctctatgaacctattctggaggcaataaaggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagatttcaggagacaagtattatctttaaatctaaatgggtgcaattcattaatgaaaaaattacagcatctttttgcctttctggcccatacacagagggaagcatacgcacctcggatattctttgaggcttccagacctccatggtttactcccagatcacagcaagactgttctgaatacctcagatttctccttgacaggctccatgaagaagaaaagatcttgaaagttcaggcctcacacaagccttctgaaattctggaatgcagtgaaacttctttacaggaagtagctagtaaagcagcagtactaacagagacccctcgtacaagtgacggtgagaagactttaatagaaaaaatgtttggaggaaaactacgaactcacatacgttgtttgaactgcaggagtacctcacaaaaagtggaagcctttacagatctttcgcttgccttttgtccttcctcttctttggaaaacatgtctgtccaagatccagcatcatcacccagtatacaagatggtggtctaatgcaagcctctgtacccggtccttcagaagaaccagtagtttataatccaacaacagctgccttcatctgtgactcacttgtgaatgaaaaaaccataggcagtcctcctaatgagttttactgttctgaaaacacttctgtccctaacgaatctaacaagattcttgttaataaagatgtacctcagaaaccaggaggtgaaaccacaccttcagtaactgacttactaaattattttttggctccagagattcttactggtgataaccaatattattgtgaaaactgtgcctctctgcaaaatgctgagaaaactatgcaaatcacggaggaacctgaataccttattcttactctcctgagattttcatatgatcagaagtatcatgtgagaaggaaaattttagacaatgtatcactgccactggttttggagttgccagttaaaagaattacttctttctcttcattgtcagaaagttggtctgtagatgttgacttcactgatcttagtgagaaccttgctaaaaaattaaagccttcagggactgatgaagcttcctgcacaaaattggtgccctatctattaagttccgttgtggttcactctggtatatcctctgaaagtgggcattactattcttatgccaggaatatcacaagtacagactcttcatatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatggtttaagtggtaataacccaaccagtggactctggataaatggagacccacctctacagaaagaacttatggatgctataacaaaagacaataaactatatttacaggtaagttggaaatacaagctttatttgttgaaaatattaaacaattgacacagttaaatgagtaccctcattttgaaatctaacatgagtttttattaaattctgaaatataggtctggatttacatgaagtattctcaacctgtataactaaattgcctttctaatattgtgacaatttaaatgaaaagtggcaattagatgtaatgcagaagactttatttgttccttacaaaagatggctcattctgaaatcatgccatacaaaatacagaaagtttacaaaagtggacatatcctccctcttcctctcagcctcacccaccagaggaaataactgctaaatgtggtatttatgccctcaagacttttgtgtaaatgttttaagggctgtttattgatatttaggtggataagattaaaaaacactaaaatgtagactatgtaaagaaaggatattcatattctttgaggatgtggttagtaaaaccaaggagataatagaacaattgtaaatcgaagccaaggaatggttttatatgagataaatttattcataaatatacttttttcaaggagttagtgattttattacttaaataaaggctaataaaaagttaaaattcttgctgaaa

SEQ ID NO: 197381 - DNA, 2177 bp, Homo sapiens
  Payload ID: 18933
  Gene Name: ubiquitin specific peptidase 39
  Uniprot ID: Q53GS9
  ENST ID: ENST00000323701
  CDS Start-End: 11-1708
ggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgttttt

SEQ ID NO: 197382 - DNA, 1946 bp, Homo sapiens
  Payload ID: 18933
  Gene Name: ubiquitin specific peptidase 39
  ENST ID: ENST00000409025
  CDS Start-End: 54-1664
gcgcgctcgagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatatttggaagaggcgagataatgatgaaaccaaccagcagggggcttgaaggaggcgtctagggctttgctcccaagggctgtggctgatgatgattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttaga

SEQ ID NO: 197383 - DNA, 2033 bp, Homo sapiens
  Payload ID: 18933
  Gene Name: ubiquitin specific peptidase 39
  Uniprot ID: Q53GS9
  ENST ID: ENST00000409766
  CDS Start-End: 3-1469
agatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgttttt

SEQ ID NO: 197384 - DNA, 2034 bp, Homo sapiens
  Payload ID: 18933
  Gene Name: ubiquitin specific peptidase 39
  Uniprot ID: Q53GS9
  ENST ID: ENST00000409470
  CDS Start-End: 28-1725
cgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatgattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 197385 - DNA, 561 bp, Homo sapiens
  Payload ID: 18933
  Gene Name: ubiquitin specific peptidase 39
  ENST ID: ENST00000442708
  CDS Start-End: 222-561
gaggccccggcctggccaagcgatgcagcgcacggagttttcgggtctggtcgggtcgggtggagtagggtatgcttgacttccaccccccggacggagggcttttgtttttgtttttttttgtttgttttttcgtaacatatcaataggaaacaaggacttcggcttacagctgataccagaaccttcagaaaaatgcaaatcatctataacacaactcgatgcttacggcggtgccttcccatcttttttctgcaaagaatggccgagtggattctgaggaccggaggagccgccactgcccgtacctggacaccattaacagcttttcacccttccctacaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatg

SEQ ID NO: 197386 - DNA, 2086 bp, Homo sapiens
  Payload ID: 18933
  Gene Name: ubiquitin specific peptidase 39
  Uniprot ID: Q53GS9
  ENST ID: ENST00000450066
  CDS Start-End: 224-1612
gggaggccccggcctggccaagcgatgcagcgcacggagttttcgggtctggtcgggtcgggtggagtagggtatgcttgacttccaccccccggacggagggcttttgtttttgtttttttttgtttgttttttcgtaacatatcaataggaaacaaggacttcggcttacagctgataccagaaccttcagaaaaatgcaaatcatctataacacaactcgatgcttacggcggtgccttcccatcttttttctgcaaagaatggccgagtggattctgaggaccggaggagccgccactgcccgtacctggacaccattaacagcttttcacccttccctacaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaacc

SEQ ID NO: 197387 - DNA, 610 bp, Homo sapiens
  Payload ID: 18933
  Gene Name: ubiquitin specific peptidase 39
  ENST ID: ENST00000448971
  CDS Start-End: 224-610
gggaggccccggcctggccaagcgatgcagcgcacggagttttcgggtctggtcgggtcgggtggagtagggtatgcttgacttccaccccccggacggagggcttttgtttttgtttttttttgtttgttttttcgtaacatatcaataggaaacaaggacttcggcttacagctgataccagaaccttcagaaaaatgcaaatcatctataacacaactcgatgcttacggcggtgccttcccatcttttttctgcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaag

SEQ ID NO: 197388 - DNA, 751 bp, Homo sapiens
  Payload ID: 18933
  Gene Name: ubiquitin specific peptidase 39
  ENST ID: ENST00000458268
  CDS Start-End: 10-474
gtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaagcttttcacccttccctacaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttca

SEQ ID NO: 197389 - DNA, 338 bp, Homo sapiens
  Payload ID: 18933
  Gene Name: ubiquitin specific peptidase 39
  ENST ID: ENST00000467885
  CDS Start-End: 1-186
tatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgag

SEQ ID NO: 197390 - DNA, 2161 bp, Homo sapiens
  Payload ID: 18933
  Gene Name: ubiquitin specific peptidase 39
  ENST ID: ENST00000613444
  CDS Start-End: 224-1687
gggaggccccggcctggccaagcgatgcagcgcacggagttttcgggtctggtcgggtcgggtggagtagggtatgcttgacttccaccccccggacggagggcttttgtttttgtttttttttgtttgttttttcgtaacatatcaataggaaacaaggacttcggcttacagctgataccagaaccttcagaaaaatgcaaatcatctataacacaactcgatgcttacggcggtgccttcccatcttttttctgcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaacc

SEQ ID NO: 197391 - DNA, 3126 bp, Homo sapiens
  Payload ID: 18934
  Gene Name: ubiquitin specific peptidase 4 (proto-oncogene)
  Uniprot ID: Q13107
  ENST ID: ENST00000265560
  CDS Start-End: 48-2939
cgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaagaagaccgtttacctagaagaagctatgtcaagaggc

SEQ ID NO: 197392 - DNA, 3222 bp, Homo sapiens
  Payload ID: 18934
  Gene Name: ubiquitin specific peptidase 4 (proto-oncogene)
  Uniprot ID: Q13107
  ENST ID: ENST00000351842
  CDS Start-End: 10-2760
gcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaatggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgc

SEQ ID NO: 197393 - DNA, 2141 bp, Homo sapiens
  Payload ID: 18934
  Gene Name: ubiquitin specific peptidase 4 (proto-oncogene)
  ENST ID: ENST00000431357
  CDS Start-End: 1-1864
tccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttat

SEQ ID NO: 197394 - DNA, 1536 bp, Homo sapiens
  Payload ID: 18934
  Gene Name: ubiquitin specific peptidase 4 (proto-oncogene)
  Uniprot ID: Q13107
  ENST ID: ENST00000416417
  CDS Start-End: 13-954
gccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaagtttcgttctttttgcccaggctggagtgcaatggcgcgatcttggctcactgcaacttctgcctcccgggttcaagcaattctcctgcctcagcttcccgagtagcgccatcacatctggctaatttttttttttttgagatggagtctcactctgtcaccaagctggagtgcggtggtgcagtctcggcttactcccgggttcaagtgatgcttctgccccagcctcccgagtggctgggatgacaggcgcccgccaccatgtccagataatttttgtatttttagtagagatgtggtttcactgtgtcttgaactcctgacctcatggccaggctggtcttgaattcctgaccttgtgatcgtgacctcatgatccgccagcctcggcctcccaaagtgctgggattacaagggtgagccacctcacccagcctaattttgtatttttagtagtgacggggtttctccatgttggtcaggctggtctcaaactcctgacctcaggtgatccgtctgcctcggcctcccaaagtgctgagattacaggcatgagccaccacgcgcgacctggctaatttcttttgcattttagtagagacagggtttcactgtgttgcccaggctggtctcgaactcctgagctcaggcaatctgcctgcctcagcctcccaaagtactaggattacaggcacgagccactgcgcctggtcagccttgtggtttttcacactgaaagggtatgtggtggtgtggactgatgtgacaggaagaccagttaatttgtggactctcacttaaataaagtttaccttgaagtagtatgaa

SEQ ID NO: 197395 - DNA, 1454 bp, Homo sapiens
  Payload ID: 18934
  Gene Name: ubiquitin specific peptidase 4 (proto-oncogene)
  ENST ID: ENST00000415188
  CDS Start-End: 13-1104
gccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaggggccccaggagatgttgacccagcagggcatggcgctgcagaactacgacaacaagctggtcaaatgcatagaggagctatgccagaagcaggaggagctgtgctggcagatccagcaggaggaggacaagaaacagcggctgcagaatgaggtgaggcagctgacagagaagctggcctgcgtcaacgagaagctggcccgcgtcaacgagaacctggcacgcaagattgcctcttgcagtaagttctaccagaccatcgcggagacggaggccacctacctcaagatgctggagagctcccagactttgctcagtgtcctgaagagggaagctgggaacctgaccaaggctacagcctcagaccagaaaagtagtggtggcagggacagctgaccagaccatgggcagggcctgcctctgtgcgcccctcaactcagccccagcaagtctgtccacagagcgtcttcttcatggcagcagctgccttctttcactgtctcaggtgctaagaggggcagctgccaacctccactggcatcagtgacaagcccggggcacagcctgtgggtcctggctttgtgctcacacaggctatggggagggtgggctctaggtcagctctgcaaggggcctgtctctgcggcacccacactcctgggctgccagggaggtcctggttgtagtctgagcaccatggaggtcccctcagccagcagaggcccagggcagggggcaggggttct

SEQ ID NO: 197396 - DNA, 5692 bp, Homo sapiens
  Payload ID: 18935
  Gene Name: ubiquitin specific peptidase 40
  Uniprot ID: Q9NVE5
  ENST ID: ENST00000251722
  CDS Start-End: 119-3826
actttctggagacccgccctcgccaacatggcggcgcccagttggggcgggttcgttcgcttcgcgttttggccagggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggagaataatctaattcctgttgatcagctgggccagaaacttttgaaaaagataggaatatcttggaacaagaagtacagaaaacagcatggaccactgcggaagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgta

SEQ ID NO: 197397 - DNA, 1946 bp, Homo sapiens
  Payload ID: 18935
  Gene Name: ubiquitin specific peptidase 40
  Uniprot ID: Q9NVE5
  ENST ID: ENST00000409945
  CDS Start-End: 744-1235
ctccaatacctaatatttaaaaattaccttttggaaactgatttataggacatattttcttccaggtatcttacctttatattgcagaaatccttaaccagaaacaaacacttctgttttctaaatgaaacaccattctttctgattatccgattctcattttactcacgggtttgatctagttatattttttccagctttattttcaaaatttttccatttttttgtgaattttattgcgataccaattatgaaataaaatcttcagttctcatctctgtatcacctcttaccattagatttaatttagtcatggatgagcctaattattgatggtaataacaatctcaactttaaacttggaagaagctacttcttcatttatggattgatttggattatctggcttttaatctatataaacaacagctctttgaacaagtcatttttattaagtaggaaactagactttcatagcttccatttagcattgttacatagaaaacaggaagacaatatcttaagagtatggaaattgaaaatcaaacctaatcttagtgcatgtaatccttttgtctgaagtgcaactcatttttcttctttcttgatattcttgattttcaaagaaatactgatttcagcatttatttttcttagagagctaggaattaataaccttcatcatattatcaaaatttttttaagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgagaacagaatgggatttcagcagccagtgcatcataaagagaagtaaattgactgcctgtgctctgagagtcaattgatatatttatttttaaaacgtaagatcttgaaaatcaagacctattaatttcataagtcattccagacatcacataataataacactgtgccatttctgtacgtgctctgtaacctctgtaaagcactatatatcttgttgtttattattatatcaatatattacactttccaaagacttttatgtatcatctctcaagatcctcagggcaacaggggccccatttatcaccacgtaccagaatattgagacttcatccaattctaatgatgtcattttagcccacaggggcagagaccaggagtccacatcctacatgtcttccaatctttctgcctcaaaaccctcaggaactgcttctagggcatttgatatcatctcactgacttctgagaaggaacatagacaagtacaagcatgttgtcttactcagcactcagccgcacacatcacgatgggcagaagtcactatcagtgagttctgttgcccttgtacaaagaggagttccacttcattataaagaaatggagcgagtatatttttaataggcccaactctttagctatgtttttctttttatcaggctttacttatttagtttttctagtgccttgaagtatattacttatatttctttttaatcttttcagcctcagtaataaaattaatataaatgagtc

SEQ ID NO: 197398 - DNA, 3744 bp, Homo sapiens
  Payload ID: 18935
  Gene Name: ubiquitin specific peptidase 40
  Uniprot ID: Q9NVE5
  ENST ID: ENST00000427112
  CDS Start-End: 37-3744
atgtcactttttttaagggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggagaataatctaattcctgttgatcagctgggccagaaacttttgaaaaagataggaatatcttggaacaagaagtacagaaaacagcatggaccactgcggaagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataa

SEQ ID NO: 197399 - DNA, 1047 bp, Homo sapiens
  Payload ID: 18935
  Gene Name: ubiquitin specific peptidase 40
  ENST ID: ENST00000430158
  CDS Start-End: 1-740
tgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttggggtgcatattgaccccatgatggccctgaagtgtcagcaagaggcccacccgcagctgttgtcagtgtgttcggacagtctgccatccaacggattcatcattgctcccgtcgctctgcccccttattctactttcttcatcctagtatcacctgacatatctgtacttactgatttatttgttagtatctgtctcccactactagaatataagtacttggtttattcattgctatatccttaatacctagaatagtaattgtgcccatgtcatagtcaataattatttattaaataaagatacacccaaaattgtctacaatcaaa

SEQ ID NO: 197400 - DNA, 348 bp, Homo sapiens
  Payload ID: 18935
  Gene Name: ubiquitin specific peptidase 40
  ENST ID: ENST00000454354
  CDS Start-End: 1-348
tggagttcggtgtcccgtccccagcccacctcagagcctggacggtggagaggaagcgcccaggcaggcttttacgaactgaccggcagccactcagcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaag

SEQ ID NO: 197401 - DNA, 628 bp, Homo sapiens
  Payload ID: 18935
  Gene Name: ubiquitin specific peptidase 40
  ENST ID: ENST00000443711
  CDS Start-End: 71-367
gggttcgttcgcttcgcgttttggccagggcgggggtctgggctttaggcaggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaagaaagtgacttggcctataccctatgggtaatggaatttgccttccgagaaagaatcagttttccaagtacaatactgctactgctttataaacatgtaacactctttactatgcttattctttcttctggtgaaggaaatatttgcagaacatccacattagcttcccccagaagtctatttaaagcactttttttgcaacaataccgacctctccaccccacacaaaaaaaaatagaggctagtattctttcaatttggtactctggaaataaattgagtaatgagttaa

SEQ ID NO: 197402 - DNA, 670 bp, Homo sapiens
  Payload ID: 18935
  Gene Name: ubiquitin specific peptidase 40
  ENST ID: ENST00000450940
  CDS Start-End: 1-292
gaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcagtctgttctgatatggcatttgtcatatgccatgttcagtggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactat

SEQ ID NO: 197403 - DNA, 453 bp, Homo sapiens
  Payload ID: 18935
  Gene Name: ubiquitin specific peptidase 40
  ENST ID: ENST00000452724
  CDS Start-End: 1-297
gaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactaggtaatcatttacattttcttttcggttcttagtttagcttaattttggtcttgaattgaagaaaatataggagaatacaaaaaacagtttagggagaactcacatacctaccacccaaaatggacaaatattaacattttgtcatatgtttgtttttgtttgaaacattataaatgaagttaaagtcc

SEQ ID NO: 197404 - DNA, 5616 bp, Homo sapiens
  Payload ID: 18935
  Gene Name: ubiquitin specific peptidase 40
  Uniprot ID: Q9NVE5
  ENST ID: ENST00000450966
  CDS Start-End: 1-3744
atgtcactttttttaagggtagtatttagtttcacaatgtttggggacctgtttgaagaggagtattccactgtgtctaataatcagtatggaaaagggaagaaattaaagactaaagctttggagccacctgctcctagagaattcaccaatttaagcggaatcagaaatcagggtggaacctgttacctcaattcccttcttcagactcttcatttcacacctgaattcagagaagctctattttctcttggcccagaagagcttggtttgtttgaagataaggataaacccgatgcaaaggttcgaatcatccctttacagttacagcgcttgtttgctcagcttctgctcttagaccaggaagctgcatccacagcagacctcactgacagctttgggtggaccagtaatgaggaaatgaggcaacatgatgtgcaggaactgaatcgaatcctcttcagcgctttggaaacttctttagttgggacctccggtcatgacctcatctatcgtctgtaccatggaaccattgttaaccagattgtttgtaaagaatgtaagaacgttagcgagaggcaggaagacttcttagatctaacagtagcagtcaaaaatgtatccggtttggaagatgctctctggaacatgtatgtagaagaggaagtttttgattgtgacaacttgtaccactgtggaacttgtgacaggctggttaaagcagcaaagtcggccaaattacgtaagctgcctccttttcttactgtttcattactaagatttaattttgattttgtgaaatgcgaacgctacaaggaaactagctgttatacattccctctccggattaatctcaagcccttttgtgaacagagtgaattggatgacttagaatatatatatgacctcttctcagttattatacacaaaggtggctgctacggaggccattaccatgtatatattaaagatgttgatcatttgggaaactggcagtttcaagaggaaaaaagtaaaccagatgtgaatctgaaagatctccagagtgaagaagagattgatcatccactgatgattctaaaagcaatcttattagaggagaataatctaattcctgttgatcagctgggccagaaacttttgaaaaagataggaatatcttggaacaagaagtacagaaaacagcatggaccactgcggaagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaagctcgagctaatccaagatatggggttccatgtcatttactgaatgaaatggatgcagctaacattgaactgcaaaccaaaagggcagaatgtgattctgcaaacaatacttttgaattgcatcttcacctgggccctcagtatcatttcttcaatggggctctgcacccagtagtctctcaaacagaaagcgtgtgggatttgacctttgataaaagaaaaactttaggagatctccggcagtcaatatttcagctgttagaattttgggaaggagacatggttcttagtgttgcaaagcttgtaccagcaggacttcacatttaccagtcacttggcggggatgaactgacactgtgtgaaactgaaattgctgatggggaagacatctttgtgtggaatggggtggaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacagcttgttgaccaaggaagagaaatgggtcactagtatgaatgagattgactggctccacgttaaaaatttatgccagttagaatctgaagagaagcaagttaaaatatcagcaactgttaacacaatggtgtttgatattcgaattaaagccataaaggaattaaaattaatgaaggaactagctgacaacagctgtttgagacctattgatagaaatgggaagcttctttgtccagtgccggacagctatactttgaaggaagcagaattgaagatgggaagttcattgggactgtgtcttggaaaagcaccaagttcgtctcagttgttcctgttttttgcaatggggagtgacgttcaacctgggacagaaatggaaatcgtagtagaagaaacaatatctgtgagagattgtttaaagttaatgctgaagaaatctggcctacaaggagatgcctggcatttacgaaaaatggattggtgctatgaagctggagagcctttatgtgaagaagatgcaacactgaaagaacttctgatatgttctggagatactttgcttttaattgaaggacaacttcctcctctgggtttcctgaaggtgcccatctggtggtaccagcttcagggtccctcaggacactgggagagtcatcaggaccagaccaactgtacttcgtcttggggcagagtttggagagccacttccagccaaggtgcttctgggaacgagcctgcgcaagtttctctcctctacttgggagacatagagatctcagaagatgccacgctggcggagctgaagtctcaggccatgaccttgcctcctttcctggagttcggtgtcccgtccccagcccacctcagagcctggacggtggagaggaagcgcccaggcaggcttttacgaactgaccggcagccactcagggaatataaactaggacggagaattgagatctgcttagagccccttcagaaaggcgaaaacttgggcccccaggacgtgctgctgaggacacaggtgcgcatccctggtgagaggacctatgcccctgccctggacctggtgtggaacgcggcccagggtgggactgccggctccctgaggcagagagttgccgatttctatcgtcttcccgtggagaagattgaaattgccaaatactttcccgaaaagttcgagtggcttccgatatctagctggaaccaacaaataaccaagaggaaaaagaaaaaaaaacaagattatttgcaaggggcaccgtattacttgaaagacggagatactattggtgttaagaatctcctgattgacgacgatgatgatttcagtacaatcagagatgacactggaaaagaaaagcagaaacaacgggccctggggagaaggaaaagccaagaagccctccatgagcagagcagctacatcctctccagtgcagagacgcctgcccggccccgagccccggaaacttctctctccatccacgtggggagcttcagataaccgcgccgctgcacggctctactcccgatgaactctccggctgatgccacaaacgtgggtttcctgggcatggggactggctgcctggcgcctccaatcccaaatcctctgcttcctttgagcacagggacggctcctctgaggcctggccagtgcatgtagtcacttagctctgcaacacgtggcagccacgggggctggtgcagctctggatgtcgcccacccagctgccagtaggtgctgggctctctcacacagcacccggccccagctgcctttttttttcttttaaccagaaaatgcacaacgtgtgcgtgaaccgcaggtatggaggcagcggcatgccgttgctccgctgtgggaggtgtgtggggtcaggccagccactttcctccgtgttcagatgactctcgttcgccctgaccggcttctcacagtgtctcaggccactgcgccaccgcgctggtgctgagcagaagcgggcagaagtggggtctgctttcaggacttcatttcccccactcgttccggccccgcatgctccacgtctgccctttggtctgagttaaaactgcgatgctgaaaagtgcgagctctttccacgaggaggagccacacagggtggcctccgagggtgagtcgctctgctaagcaagggcagccgctgcacgtcagcccgcaggccaagggtccagcttatcctgggtgctctgtgatcagaaggtccttggatcccgaggactgcagctgctgccgtccacagcgcctcagcctctcttcctgtgtggaagcggggcaggcagggctgtggcagacaggcctggcatagcccaggttccaggtgtcctgggcagcctgaccggtttcctgagtagcctcaatgaaaacacctgagaaaaagaaaatgtaaactaaggaagggttttcccacttaatccaacccagatttctattcaacttaaaggatttaattggcatttgtgagaaataatagtacctgtgtcactgagttgattgatttgggacatagacggttgactttcccagacagcagcttagcggaaagcagcatcccgaagacggtgtcgcatgtcctgagcctgcttgtcacctgggcctcacggtttctcgtcagccccgtcactgatgggaagcagcactgaagtgtgagggcagaaaggacaccgctggagtcaggcgctcccctgcctgtgacccttttccaacaagctgatgctgagccagcggcctgctttgtccctcatactcctcccaacagtccaaacccctaccagacagaagccacgtcgcttctgcacacgtgtctgagagcgtctgccatagacgtctgtgcgtttccgtgaagcactgcgccctaaggacccaactctgactagcagctgcctcccactcccaaacactaaccccgctcaggagactcgcactgggtgtagactgcgtctttgcagagggagatgatagaggcttctgatgacgccagagctgtaagtgtcgtgacgagctgggcgcccagcccttcttaagctgttctgtttctgtggctttaactgacatatttctgtagcatctgccttcatctcatctcagcgtaatgaaatattaatgaaatcgctgaaaagctttgccttcgagaggccagaagcctcgcggaatgtctgcaagtccaaagacgcgtgtgggttgtgccctgaagtgccgtccagcaggcgcgtgcggccgggccggcctgtgcgtgtggcctttgccttcttccctttcttcctgttttctgtttttttaatttggggattgagaaagctgtacgattttgttaaagaaaaaaataaaccattttttaaagttgtagccctt

SEQ ID NO: 197405 - DNA, 920 bp, Homo sapiens
  Payload ID: 18936
  Gene Name: ubiquitin specific peptidase 41
  ENST ID: ENST00000292729
  CDS Start-End: 1-920
gcctggttggtttacacaacattggacagacctgctgccttaactccttgattcaggtgtttgtaatgaatgtggacttcgccaggatattgaagaggatcacggtgcccaggggagctgacgagcagaggagaagcgtccctttccagatgcttctgctgctggagaagatgcaggacagccggcagaaagcagtgtggcccctggagctggcctactgcctgcagaagtacaacgtgcccctgtttgtccaacatgatgctgcccaactgtacctcaaactctggaacctgattaaggaccagatcgctgatgtgcacttggtggagagactgcaggccctgtatatgatccggatgaaggactccttgatttgccttgactgtgccatggagagtagcagaaacagcagcatgctcaccctccgactttctttttttgatgtggactcaaagcccctgaagacactggaggacgccctgcactgcttcttccagcccagggagttatcaagcaaaagcaaatgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggtaa

SEQ ID NO: 197406 - DNA, 1077 bp, Homo sapiens
  Payload ID: 18936
  Gene Name: ubiquitin specific peptidase 41
  Uniprot ID: Q3LFD5
  ENST ID: ENST00000454608
  CDS Start-End: 1-1077
atggacggcgtcttgttcagggctcatcagtgtcagtacgtgcatccttgtgtacatgtgtatgtcactgtgggcctcatggatcccctgtgtcgccgaaagagtaaatcacgtaaacaaaacaaactgcaacctaacctgagaatatgcccttggagcctggttggtttacacaacattggacagacctgctgccttaactccttgattcaggtgtttgtaatgaatgtggacttcgccaggatattgaagaggatcacggtgcccaggggagctgacgagcagaggagaagcgtccctttccagatgcttctgctgctggagaagatgcaggacagccggcagaaagcagtgtggcccctggagctggcctactgcctgcagaagtacaacgtgcccctgtttgtccaacatgatgctgcccaactgtacctcaaactctggaacctgattaaggaccagatcgctgatgtgcacttggtggagagactgcaggccctgtatatgatccggatgaaggactccttgatttgccttgactgtgccatggagagtagcagaaacagcagcatgctcaccctccgactttctttttttgatgtggactcaaagcccctgaagacactggaggacgccctgcactgcttcttccagcccagggagttatcaagcaaaagcaaatgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggttctgcttcaatgactccaatatttgcttggtgtcctgggaagacatccagtgtacctacggaaatcctaactaccactggtaa

SEQ ID NO: 197407 - DNA, 5155 bp, Homo sapiens
  Payload ID: 18937
  Gene Name: ubiquitin specific peptidase 42
  Uniprot ID: Q9H9J4
  ENST ID: ENST00000306177
  CDS Start-End: 159-4109
aggggcgcggcgggcgcggcgctgacccggaggcggcggcggcggtgcccggatggaggcacgtcattgtcccccgccgggcggctgggctgtgtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattcaagaaaatcagaggactttgttaaagattcagaactgcacttacccagggtcaccagcttggagactgtcgcccagttccggagagcccagggtggctttcctctctctggtggcccgcctctggaaggcgtcggacctttccgtgagaaaacgaaacacttacggatggaaagcagggatgacaggtgtcgtctctttgagtatggccagggtgattgaaaactcagcctcaaaacaaaaaattcactagttatgattcaacgcgttcaacagaagccatccccagcccagcttaaattataaagatagacaataactctgttccaatctgcgtggtgcttctttagtaaatactgtacagattttaccatggagaactttttttttagtttttaccttttcttaattacccttattccgaatggacgaacactttctaccactgctgaccattgtaaaataccgtgtatataaatcccattgaaataatgccctggaatagaacatctcaaatgctgcttaattacagactcaggtcgattacttgtatttcatgtaatgttcctccaagttagacatctggtgcaagaccaaccgggagaccatggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgacagtatgtttctattacacaacactttttgatacagcgtctcttgtcttcactgatactggagtctccgttgtctgcttggtcccttcgagtttctagttacagacacaatcatactgtgattttatttttaatatggatatgctatcaaactgtgatacacttataattcactggtcctgcatcaggagatggagtggggaaaactgtatttaatacagtttgtatctgaataatctgtatggtttatacagtttgtgttgttcagagatgtttaaagtttgatctttgtttttctaaagattaaaaaagcacttgccccactgtaaatatacagcatgtaaaatttctatagtatataaatggcagcaaatcaca

SEQ ID NO: 197408 - DNA, 1380 bp, Homo sapiens
  Payload ID: 18937
  Gene Name: ubiquitin specific peptidase 42
  ENST ID: ENST00000404008
  CDS Start-End: 93-617
ttgtcccccgccgggcggctgggctgtgtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacattccataattcattccccacagacagctttcctatcacttttgcgcttaatgaaagtagggtgtggatgaaaacccagcactagcacctggacagcaagagagaggaccaagacaaaattcagaagctcccgatgtccagaattagagatttggtctcgctgtgttacccaggctggtctcgaactcctagcctcaagtgatcctcctgccttggcctctgaaagtgttggaattacaggtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagag

SEQ ID NO: 197409 - DNA, 3611 bp, Homo sapiens
  Payload ID: 18937
  Gene Name: ubiquitin specific peptidase 42
  ENST ID: ENST00000426246
  CDS Start-End: 481-3611
ctgttctttgatctaaattaatggctcagattcatgtgtgtatgttctggggctattagttactaggatttaaaaaaaaaaatccttggtttctttttgaatagttctttacttaatggagaatttaaattggttcttttaaaactgatttttttttccctccaaagagccaagtaatgcttgtaaagaatttggaaagtacagaaaaacttaaagaaaccaaagaaaaatcacctagaatctcaccacctacctaggggtgtttgttatgccagaattaacgttctgtttgccctcattttctccctttctcagtccataattcattccccacagacagctttcctatcacttttgcgcttaatgaaagtagggtgtggatgaaaacccagcactagcacctggacagcaagagagaggaccaagacaaaattcagaagctcccgatgtccagaattaggtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatc

SEQ ID NO: 197410 - DNA, 520 bp, Homo sapiens
  Payload ID: 18937
  Gene Name: ubiquitin specific peptidase 42
  ENST ID: ENST00000451154
  CDS Start-End: 66-362
gtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagtagagacgggggttcaccatgttagccaggatggtctcgatcttctgacctcatgatccacccacctcagcgtcctgaagtgctgggattacaggcatgaaccaccacgccaggcccttttattccagttttttttaagaataaactttatcttgccctaggtgatggcatcgctcctccacagaaagttcttttcccatctgagaagatttgt

SEQ ID NO: 197411 - DNA, 1490 bp, Homo sapiens
  Payload ID: 18937
  Gene Name: ubiquitin specific peptidase 42
  ENST ID: ENST00000465073
  CDS Start-End: 66-1490
gtgcggcggcggcggcggcggccgagggggatggagcgagcgccgagccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaaggtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcat

SEQ ID NO: 197412 - DNA, 5017 bp, Homo sapiens
  Payload ID: 18937
  Gene Name: ubiquitin specific peptidase 42
  ENST ID: ENST00000521713
  CDS Start-End: 21-680
agccgggtcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgcagaaagcatgcttgaatggcagcaataagtaagtacaacagagcgccagccatgtcttcattggggatctctggttgtagtttattcttatcagaattcattttcaccttttttgttggaagcacacagaacagtgttcactttaccttttggctttgctctgcctcttccttaggtgatgtgcattattttaaaatggttgaaatttacacgtgtgtcttacgtaacagtttgagttggctcaatcatagatgtcaggaaataaacattggtcttgcagctatttaatttctcattatcagcagacgtctgcagatctcaaactagctgcttctcctttctagttgtgcctgacattttcttttctctgctgccctccagcctgtgtttatttcctgaacccccaccccaatcagttactgattcttgtagctagttccttaaaatctaaatgcagactcaagaggaagaacgaggggacagataatgcatcccaagccgcttggtgctgtctgagacacctggtagatctccctctgcattctccctgccctggcaccgccctgtctaggacttcattgtccgggtgatgacatacttgggtcggaggaagactctctgccttttccgcctccgctccctttcctcccacacaggccgcagtgcccggaggctgccatcttcctgcttcaggaccagactcctgccttgcttcccgagtcccttcctgacagacacagctcccacagctctgcgtctcctcccgccactcccagacctccctgtgttctggccaggaagggatgctcttgggctgccacacgtgccatccttttattttccatggctgtcctgtttgaattcttgatcttttgtgagctcccatgtgtttgaaatctggtcacagcatctggagtttttgcaaagctcttctctcatgtcactgttcaacgtttttcagattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaagaagaagaaaaagaagagacattcaagaaaatcagaggactttgttaaagattcagaactgcacttacccagggtcaccagcttggagactgtcgcccagttccggagagcccagggtggctttcctctctctggtggcccgcctctggaaggcgtcggacctttccgtgagaaaacgaaacacttacggatggaaagcagggatgacaggtgtcgtctctttgagtatggccagggtgattgaaaactcagcctcaaaacaaaaaattcactagttatgattcaacgcgttcaacagaagccatccccagcccagcttaaattataaagatagacaataactctgttccaatctgc

SEQ ID NO: 197413 - DNA, 4169 bp, Homo sapiens
  Payload ID: 18938
  Gene Name: ubiquitin specific peptidase 43
  Uniprot ID: Q70EL4
  ENST ID: ENST00000285199
  CDS Start-End: 97-3468
cggcaccaggagccttagagaagctgtagggcctgctggccgctcgtccgcctcgcgcccgggggctccgcgcctggagctgcgccggcggcagccatggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaatttttttttttttgtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatgaaacacg

SEQ ID NO: 197414 - DNA, 3500 bp, Homo sapiens
  Payload ID: 18938
  Gene Name: ubiquitin specific peptidase 43
  Uniprot ID: Q70EL4
  ENST ID: ENST00000570475
  CDS Start-End: 97-3453
cggcaccaggagccttagagaagctgtagggcctgctggccgctcgtccgcctcgcgcccgggggctccgcgcctggagctgcgccggcggcagccatggacctgggccccggggacgcggcaggagggggaccgctcgcgccccggccccgccgccgccgctccctgcgccgcctgttcagccgcttcctgctggcgctgggcagccgctcacgccccggggactcaccgccccggccccagccgggacactgtgatggcgacggtgaggggggcttcgcctgcgccccgggcccagttccagcggcccccgggagccccggggaggaacgcccgcccggaccccagccccagctccagctccccgccggcgatggggcgcggccgccgggcgctcagggcttgaagaaccacggcaacacctgtttcatgaacgcggtggtgcagtgtctcagcaacaccgacctgctggccgagttcctggcgctggggcgctaccgggcggctccgggccgcgccgaggtcaccgagcagctggcggcgctggtgcgcgcgctctggactcgcgaatacacgccccaactttccgcggagttcaagaatgcagtttccaagtacggctctcagttccaaggcaattcccagcacgacgccctggaattcctgctctggttgctggatcgtgtacatgaggacctggagggttcatcccgagggccggtgtcggagaagcttccgcctgaagccactaaaacctctgagaactgcctgtcaccatcagctcagcttcctctaggtcaaagctttgtgcaaagccactttcaagcacaatatagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgcc

SEQ ID NO: 197415 - DNA, 3425 bp, Homo sapiens
  Payload ID: 18938
  Gene Name: ubiquitin specific peptidase 43
  ENST ID: ENST00000574408
  CDS Start-End: 1-2731
ggcaattcccagcacgacgccctggaattcctgctctggttgctggatcgtgtacatgaggacctggagggttcatcccgagggccggtgtcggagaagatcttccttgacttgtccccactgcctgaaacagagcaacacctttgatcctttcctgtgtgtgtccctacctatccccttgcgccagacgaggttcttgagtgtcaccttggtcttcccctctaagagccagcggttcctgcgggttggcctggccgtgccgatcctcagcacagtggcagccctgaggaagatggttgcagaggaaggaggcgtccctgcagatgaggtgatcttggttgaactgtatcccagtggattccagcggtctttctttgatgaagaggacctgaataccatcgcagagggagataatgtgtatgcctttcaagttcctccctcacccagccaggggactctctcagctcatccactgggtctgtcggcctccccacgcctggcagcccgtgagggccagcgattctccctctctctccacagtgagagcaaggtgctaatcctcttctgtaacttggtggggtcagggcagcaggctagcaggtttgggccacccttcctgataagggaagacagagctgtttcctgggcccagctccagcagtctatcctcagcaaggtccgccatcttatgaagagtgaggcccctgtacagaacctggggtctctgttctccatccgtgttgtgggactctctgtggcctgcagctatttgtctccgaaggacagtcggcccctctgtcactgggcagttgacagggttttgcatctcaggaggccaggaggccctccacatgtcaagctggcggtggagtgggatagctctgtcaaggagcgcctgttcgggagcctccaggaggagcgagcgcaggatgccgacagtgtgtggcagcagcagcaggcgcatcagcagcacagctgtaccttggatgaatgttttcagttctacaccaaggaggagcagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaatttttttttttttgtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatg

SEQ ID NO: 197416 - DNA, 2641 bp, Homo sapiens
  Payload ID: 18938
  Gene Name: ubiquitin specific peptidase 43
  ENST ID: ENST00000573955
  CDS Start-End: 1-1947
gcagcctgttcgggagcctccaggaggagcgagcgcaggatgccgacagtgtgtggcagcagcagcaggcgcatcagcagcacagctgtaccttggatgaatgttttcagttctacaccaaggaggagcaggtcccgccctgggggtccatgccccggccgggaagggggctggctgcctttggtgggttggccacgtgctgcgggggcctcacagtccgggtggtttgctttccagctggcccaggatgacgcctggaagtgtcctcactgccaagtcctgcagcaggggatggtgaagctgagtttgtggacgctgcctgacatcctcatcatccacctcaaaaggttctgccaggtgggcgagagaagaaacaagctctccacgctggtgaagtttccgctctctggactcaacatggctccccatgtggcccagagaagcaccagccctgaggcaggactgggcccctggccttcctggaagcagccggactgcctgcccaccagttacccgctggacttcctgtacgacctgtatgccgtctgcaaccaccatggcaacctgcaaggtgggcattacacagcctactgccggaactctctggatggccagtggtacagttatgatgacagcacggtggaaccgcttcgagaagatgaggtcaacaccagaggggcttatatcctgttctatcagaagcggaacagcatccctccctggtcagccagcagctccatgagaggctctaccagctcctccctgtctgatcactggctcttacggctcgggagccacgctggcagcacaaggggaagcctgctgtcctggagctctgccccctgcccctccctgccccaggttcctgactctcccatcttcaccaacagcctctgcaatcaggaaaagggagggttggagcccaggcgtttggtacggggcgtgaaaggcagaagcattagcatgaaggcacccaccacttcccgagccaagcagggaccattcaagaccatgcctctgcggtggtcctttggatccaaggagaaaccaccaggtgcctccgtcgagttggtggagtacttggaatccagacgaagacctcggtccacgagccagtccattgtgtcgctgttgacgggcactgcgggtgaggatgagaagtcagcatcgccgaggtccaacgtcgcccttcctgctaacagcgaagatggtgggcgggccattgaaagaggtccagccggggtgccctgtccctcggctcaacccaaccactgtctggcccctggaaactcagatggtccaaacacagcaaggaaactcaaggaaaatgcagggcaggacatcaagcttcccagaaagtttgacctgcctctcactgtgatgccttcagtggagcatgagaaaccagctcgaccggagggccagaaggccatgaactggaaggagagcttccagatgggaagcaaaagcagcccaccctccccctatatgggattctctggaaacagcaaagacagtcgccgaggcacctctgagctagacagacccctgcaggggacactcacccttctgaggtccgtgtttcggaagaaggagaacaggaggaatgagagggcagaggtctctccacaggtgccccccgtctccctggtgagtggcgggctgagccctgccatggacgggcaggctccaggctcacctcctgccctcaggatcccagagggcctggccaggggcctgggcagccggctcgagagggatgtctggtcagcccccagctctctccgcctccctcgtaaagccagcagggccccgagaggcagtgcactgggcatgtcacaaaggactgttccaggggagcaggcttcttatggcacctttcagagagtcaaatatcacactctttctttaggtcgaaagaaaaccttaccggagtccagcttttgatggagcgtgtcagtattgtgtgacgctggcattcttgggactttgccaagcaactgtaggcagctcatgttgagaatgggtttccaggaaacccgttgtcttgtaatctctaaaaaaaaatttttttttttttgtggtggggggtctccatatctagacttccaacacccaaggtccatataacccaaggtcgaaaaccttcctgcatcattgggtgctttgctacagtttggccactagaggatgctattgggtcagtattaccagtttcagggcaagaactgatatttactaaagagttttggatgtgggcaaacaagatgaggctggtttaataagaatcttcaatgtcatgtcaaatactgtcaatggcttttcctttttctttcttttttttttttaaattgtggacttaaagaaaaatattttatttttaatgcttttctgggataagcattaaagatgccaaaaagaaaaaaaaaacaaaagaatgatagtgatggtaaggcaagattctagcaaagagagatgggagataaatggctgagagttcaggtgaatatttaatatattaaaaattgtattaaagtttttcaaggtattttaaaaataactattttgatactagaaaaaaagtccattttttaatttaaatatgagatctatgtacaattttaataaaatcctgtccatg

SEQ ID NO: 197417 - DNA, 4022 bp, Homo sapiens
  Payload ID: 18939
  Gene Name: ubiquitin specific peptidase 44
  Uniprot ID: Q9H0E7
  ENST ID: ENST00000258499
  CDS Start-End: 290-2428
gacttcaggaaagcagtttccaggaggtgagagtttaagccaaacctgaaagaggttgatttgtaatgatttgcaggggggcactggaggcagccgccaggacttttcacttaggagatcagcatttgccctgatggaaactgggcgatcctgcagggactgacctctgagttatccaaaggccgacctggggaaagactgattttgaggttttaatagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaatttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaaaaaaaaaaactaaaagctatctatctaaacttgcacaaaaaaaaatacagtgtgagtcactctttttcttcttctgataatctcactgggtttctttaaagtcctgttgctgctaactttatcttatttggagagggtagaatcaactaatctctgtagaccagctatgtatctaagctctgttaaccacaggaagatcatgtatcccttttttataagtgggtttatttgcaggttgaagtcttagtgaaagatagtatcctgtagaatgctgttcaccactagtgatcatctgttaagtacaaacttgaaagaggtctctaccaataaatttttcttaaatttcacaaaacaagtcatctgggttagctgatagtgaggtgcagtgagacttttatcactgaatagacaaatcatttgtgccgaaaatacatctggaatattaaatggctatgtttaaaattgttcataatacctatgcaagttgttacctcaactgttacacacttcttaatacctcattaaaaatttacatggtcaagataa

SEQ ID NO: 197418 - DNA, 3161 bp, Homo sapiens
  Payload ID: 18939
  Gene Name: ubiquitin specific peptidase 44
  Uniprot ID: Q9H0E7
  ENST ID: ENST00000393091
  CDS Start-End: 145-2283
gggtcgtcgcggccgccgaaccggggggcggggggccggggtgagcgctaagatggccgccccggctcgggctgttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaatttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttg

SEQ ID NO: 197419 - DNA, 2499 bp, Homo sapiens
  Payload ID: 18939
  Gene Name: ubiquitin specific peptidase 44
  Uniprot ID: Q9H0E7
  ENST ID: ENST00000537435
  CDS Start-End: 361-2499
gattaccgcgaggtgatgctcgaagccccggggcacttcgggagggcggttgtggcactcggttgaggaggaatgcgcttcccggcgtcttgcccgccttctctccatcgatcggtccccgcgctgccggcacctgctgccgcttaaagcttgaaaatcagcttcctaaagccattcccgatggccttcgatgggaaagaatgccatatggctgaattcattatgggggataagaaatatgtcagtgtgcgcggaggggaacctgttaatacgttcaaatttaagagtagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctga

SEQ ID NO: 197420 - DNA, 666 bp, Homo sapiens
  Payload ID: 18939
  Gene Name: ubiquitin specific peptidase 44
  ENST ID: ENST00000551837
  CDS Start-End: 174-666
gggcggggggccggggtgagcgctaagatggccgccccggctcgggctgccaactgtcaagtctgttcggcctcagagtatgttatagagccatgaattaaagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacat

SEQ ID NO: 197421 - DNA, 1818 bp, Homo sapiens
  Payload ID: 18939
  Gene Name: ubiquitin specific peptidase 44
  ENST ID: ENST00000552440
  CDS Start-End: 71-1561
ttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcagcaaagcgtagaaggttttcctccaaaccagttgtactcacagaagcccagaaacaacttatgatatgccacctacctcaggttctcagactgcacctcaaacgattcagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaa

SEQ ID NO: 197422 - DNA, 677 bp, Homo sapiens
  Payload ID: 18939
  Gene Name: ubiquitin specific peptidase 44
  ENST ID: ENST00000549639
  CDS Start-End: 344-677
gctaagatggccgccccggctcgggctggtgagtgtgcgcgagggcgcgcggccgcggcgattggcggagtgaggacccctgcgggagcggacgtgcgacggcagcccccggggccgggaggcacctgggggcctattctcgccgcgcagggcgctggggggtcctgagagagggagagcctggggctgcgggcgcgcggaagggaatgagccgaggggcgcgcggcggcgacgcgtccggcgaattttgaattgcccccctgggaagtttcgttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacacaactggagacctgaagttactacgacgtacattaagtgccatcaaaagtcaaaattatcact

SEQ ID NO: 197423 - DNA, 1444 bp, Homo sapiens
  Payload ID: 18940
  Gene Name: ubiquitin specific peptidase 45
  ENST ID: ENST00000329966
  CDS Start-End: 109-978
tgggggcgggcgaacgaggccccacctctgccgggagcgggacgagcgcgcaggcgcagtctccccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaagtgggtgcatctacatttaatataaataattatgagttacaaaatactaatgtattcatcatttaacatgaatagtcgtttttactgtaactttgctcttattgccctgactatgaagagaactaaaatttgttacagctctatgctttatgaaaattatatctcagtcctcagaagaagcagcttatcctcatatataaggaaatggagacacagaaattaaatggctcacctagtctgagtgaaaagctgagaatcaaatggagatctgtcctgacttggatgcctatgttgtaataccataaagtgagaaaaccatagagttgtaaaatctagaaagtaccgtaagataacatctaatctagctttcttattttaaaagatgagctgtgaggcaaatagagtttaagtgaatttctcaaggtattacagtatgtttaaaaaccaaatccttatgtgcctggaaataaacacataaaggatctgacttg

SEQ ID NO: 197424 - DNA, 6255 bp, Homo sapiens
  Payload ID: 18940
  Gene Name: ubiquitin specific peptidase 45
  Uniprot ID: Q70EL2
  ENST ID: ENST00000327681
  CDS Start-End: 534-2978
ggcgctttggtcgcagcggcggtatggtcgccgcagtttctcggtcttcgcttcggcgaccttgacccccttgtgggtgggcgaggctggaagagaggctccccaccccactcggcttcctgatccctgggggcgccgggcggtcaccgagggccgtgtgagcgccgctctgccggctccgggtccatgcggctgcgggagaagccctgggcgtcggggctggcctgggaggggcccgagtcccctggtgacctgggcgcgcggcggccccacacctttccgtccgcctcatcgcggcgcatttctcttcacatcctcggggtgtgtgtgtgttggtgaccggaggaagcctgtctaatgacttttctggaagcgtcgtgtattaggagctccggggccggactgcttgggtccgcatctccatccaccgcttactggctttgggacctctgcaagtcacttcacttctctttctcagtttcaagtgtaaaatgcggaaaataatagcaacttatctcctaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgtta

SEQ ID NO: 197425 - DNA, 2514 bp, Homo sapiens
  Payload ID: 18940
  Gene Name: ubiquitin specific peptidase 45
  ENST ID: ENST00000369233
  CDS Start-End: 42-2342
ggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaaggagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaat

SEQ ID NO: 197426 - DNA, 5319 bp, Homo sapiens
  Payload ID: 18940
  Gene Name: ubiquitin specific peptidase 45
  ENST ID: ENST00000496518
  CDS Start-End: 1-628
aggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctgggcacctcgatttaaagatttccagcaacaggacagtcaggagcttcttcattatcttctggatgcagtgaggacagaagaaacaaagatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgttacaa

SEQ ID NO: 197427 - DNA, 658 bp, Homo sapiens
  Payload ID: 18940
  Gene Name: ubiquitin specific peptidase 45
  ENST ID: ENST00000496090
  CDS Start-End: 1-446
agcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagatagggttttgtcatgttggctgggctggtctcaaactcctgatgacctcaagtgatctacctgccttggtctcccaaagtgctggaattgcaggtgtgagccacagcgctgggcctgaatttaacttactctgttagaagacttatgttagaagtcacaagacttcagaaaggacaacatgttttctataaataaaagctaattttgcttcataa

SEQ ID NO: 197428 - DNA, 1741 bp, Homo sapiens
  Payload ID: 18940
  Gene Name: ubiquitin specific peptidase 45
  ENST ID: ENST00000506871
  CDS Start-End: 11-1048
taaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagatgtaactagacaaaatgtttaagtgctccaaagactcctgcaaataaaccgtttattgaagagagtgctgcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagatagggttttgtcatgttggctgggctggtctcaaactcctgatgacctcaagtgatctacctgccttggtctcccaaagtgctggaattgcaggtgtgagccacagcgctgggcctgaatttaacttactctgttagaagacttatgttagaagtcacaagacttcagaaaggacaacatgttttctataaataaaagctaattttgcttcataagatatataggacagttaaattcaatttgagcatatgctttattctaatggtataaaacaaagcatcttacagagtttgaaaaggttaaagcattaattgtgttgctattcccctaaaaagcactggttattaaa

SEQ ID NO: 197429 - DNA, 622 bp, Homo sapiens
  Payload ID: 18940
  Gene Name: ubiquitin specific peptidase 45
  ENST ID: ENST00000511403
  CDS Start-End: 1-408
ctttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagatagggttttgtcatgttggctgggctggtctcaaactcctgatgacctcaagtgatctacctgccttggtctcccaaagtgctggaattgcaggtgtgagccacagcgctgggcctgaatttaacttactctgttagaagacttatgttagaagtcacaagacttcagaaaggacaacatgttttctataaataaaagctaattttgcttcataaga

SEQ ID NO: 197430 - DNA, 1617 bp, Homo sapiens
  Payload ID: 18940
  Gene Name: ubiquitin specific peptidase 45
  ENST ID: ENST00000472914
  CDS Start-End: 534-1403
ggcgctttggtcgcagcggcggtatggtcgccgcagtttctcggtcttcgcttcggcgaccttgacccccttgtgggtgggcgaggctggaagagaggctccccaccccactcggcttcctgatccctgggggcgccgggcggtcaccgagggccgtgtgagcgccgctctgccggctccgggtccatgcggctgcgggagaagccctgggcgtcggggctggcctgggaggggcccgagtcccctggtgacctgggcgcgcggcggccccacacctttccgtccgcctcatcgcggcgcatttctcttcacatcctcggggtgtgtgtgtgttggtgaccggaggaagcctgtctaatgacttttctggaagcgtcgtgtattaggagctccggggccggactgcttgggtccgcatctccatccaccgcttactggctttgggacctctgcaagtcacttcacttctctttctcagtttcaagtgtaaaatgcggaaaataatagcaacttatctcctaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaagtgggtgcatctacatttaatataaataattatgagttacaaaatactaatgtattcatcatttaacatgaatagtcgtttttactgtaactttgctcttattgccctgactatgaagagaactaaaatttgttacagctctatgctttatgaaaattatatctcagtcctcagaagaagcagcttatcctcatatataaggaaatggagacacagaaattaaatggctcacctagtct

SEQ ID NO: 197431 - DNA, 5826 bp, Homo sapiens
  Payload ID: 18940
  Gene Name: ubiquitin specific peptidase 45
  Uniprot ID: Q70EL2
  ENST ID: ENST00000500704
  CDS Start-End: 45-2489
ccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagcatatggaaaagaaggtgtgaaaatgaacttcatagatcggatctttattggtgaattaactagcacggtcatgtgtgaagaatgtgcaaatatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagagctgccaagaagcattcttcatctaaagataagagtcaactaattcatgaccgaaaatgtattagaaaattgtcatctggagaaactgtcacataccagaaaaatgaaaaccttgaaatgaatggggattctttaatgtttgccagcctcatgaattctgagtcacgtctgaatgaaagccctactgatgacagtgaaaaagaagccagccattctgaaagcaatgttgatgctgacagtgagccttcagaatctgaaagtgcttcaaagcagactgggctgttcagatccagtagtggatccggtgtgcagccagatggacccctttaccctctgtcagcaggtaaactgctgtacaccaaggagactgacagtggtgataaggaaatggcagaagctatttctgaacttcgtttgagcagcactgtaactggagatcaagattttgacagagaaaatcagccactaaatatttcaaataatttatgttttttagaggggaagcatttgaggtcttatagtccccaaaatgcttttcagaccctttctcagagctatataactacttctaaagaatgttcaattcagtcctgtctctaccagtttacatctatggaattactaatggggaataataagcttctatgtgagaattgtactaaaaacaaacagaagtaccaagaagaaaccagttttgcagaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgataatgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccgtgttttatgtgcttttatatttttataataaatattaaagtaaaactattaaaaattgtttatccacgtaccacttaacttaaaatcatctcagggccatctagtggtatatatgtgtactaccatttaggaaactgctataacacataatttcatgaagtaacacctaatacggtgtagttccctggtcatattttatacaattcaaccatataaaagggtgtcactgtaatttcagtagtgtgggtttacaaataatctgctggttagcttattaccttgaggttttgaaaaactagaattatattgaggcatttcataaacatatctcttgcaccctcttcatggtggagttaaggataacttgcaggtggttggccaaggcccaatatagatgattataacatttagaattggcaattagaagttgataatccatataggaccataggatagctttgaaatataaattaccaaattatatttgtaaatgatagagaattatattcttaacagaaaaatatatactttttctacttcttgtaaatactaaacacagttttggggttttgaaatcactttgtcttcagcaagcatcattaataagttcaggtgaatttagcttttaatggggcattaagctggcatttttgattttctttttaaataatagcaaaaatatcatttttcccctctagaatacaaattattgagctgtcaaaacttggcatgaagaatatactattacttaggcttaaatatcaaaagataatggctacttcagtgtcatattgttgaaatagaaacaaaactgcatggttcaagcatcctaatcattagtgccaatgaatgatagtgcaggcaagtgccaggtaaatgcctagtcccacttcattctcctcctgggaagaaaggataagaatagtggctgcagataaggtatggaaatatttaatcaagactgtcttaaacacataagcatatataatgttatcaaggttaccagtgctgccttttgatatatggatgaacataactgtaattaaagacggtaatagtatacaaaatgcagagcttaaaaatgtcattgcataaattctatttttaagatgttgaaatgttagtagtgtttttcttgatttttaacagtgaaataatcaagaaatatatctttaagttaatctgcaaagtcaggctgtgttctgtaaaaggtatttcacagcattttctgtttaactgtaatctgttatcatggagatctcagtaccagagcagtgaattttttgaaaaatattgactgtctttattcaagtcagccatcttggtaagagcagttttcatccccccactgcccaaatgtaaatatagatcacctaatttttcttacagaaagatactgttaagaggcatgcacttttcatcggatggtcacttgtttcttgtttcaaagacaaatatttggatagatacccatacttgctatgagtcagtcacagtgctgacactattttaacatcatttaaaatggaaagatctacatagatttttgacattattccagaagtaacatgcaagtaagatatttttattgtcattttcttcatgttaaaggagctacttatgaaacctatttttttatggcctagagtttatgagtgctttttccttgtcttctgaaaatggaataaattggatttttgatacttaagaatttcctaaagatagcttttgtaacagagaaagcatgttaaattacacatgggtctaccttaaaatttttgttattatttccaaagcacatttgcagggatagtaaatgtatatagtagcaagtctactataataacagtagtttctggatcacctcaggaaacagtataaataaataataatgtttacttatcatcaacataactaccatagtgtttgaatgaattaaagtttcattagctttatttagaaactggtttaccccagcttcccgtttttttccaaatataaaatgataaaatattgattatgtgccaatattgtcatttaatgttcttaaaacttgtgaagaccacctttttaggtagctgagaagagtgatagttggtatcaatttgttagccaggcatggtggctcatgctgttgggaggctgagtggggaagatgcttgagcccaggaggtcaaggtgcagtgaaccatgatcacaccactgcattcctgcagagtgacggagtgagaccctgtctcaaaaataaataaaaagaagacagttggtatcaattcaaagaatagttgatgcctgttctcttattttaaatgtaccaacagagctattttactgtatttaatagttcttagcttccatgtgtgatgattttaatcagtgattttatgcaatagctgaagaaaattttctgaagattaagctgtgaaatgtatcaaccctcatctaatttttgtagtacaaaatgacatcctgattccttttaaaaattcacgtttgtaatttatttttctgcatgtattgatcaaataagcctaaaccaaatatgtgcaataaaattgagcctttagatagtatctagtgcattgttaaaaaagattatttctagatatttatgatgtttttgtttacgtagaaatcatgaattcaaatgtttaaaagatgaccatattttcaattttgagtaatacatattattcctactgttttttttcttttgccatgtttctagaaaacagctgtgtaacttattgagcgttattttggtgttactgtataaaacatgcataataaatattcttatttatctcatgttacaagattggtcctggaattttcacagtttacgttattgacagaatgttttatcaacaatg

SEQ ID NO: 197432 - DNA, 715 bp, Homo sapiens
  Payload ID: 18940
  Gene Name: ubiquitin specific peptidase 45
  ENST ID: ENST00000507717
  CDS Start-End: 1-575
cacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaaggcacctcgatttaaagatttccagcaacaggacagtcaggagcttcttcattatcttctggatgcagtgaggacagaagaaacaaagcgaatacaagctagcattctaaaagcatttaacaacccaactactaaaactgctgatgatgaaactagaaaaaaagtcaaagatctccacggtgaaagatccattcattgatatttcacttcctataatagaagaaagggtttcaaaacctttactttggggaagaatgaataaatatagaagtttacgggagacagatcatgatcgatacagtggcaatgttactatagaaaatattcatcaacctagag

SEQ ID NO: 197433 - DNA, 469 bp, Homo sapiens
  Payload ID: 18940
  Gene Name: ubiquitin specific peptidase 45
  ENST ID: ENST00000508908
  CDS Start-End: 313-469
gataaaagttggtgctggagaggcagcatgcaaagcgaaaagaagggactgctttgagttctagacccaacgcctccgggaccaccaagctcaccgcagagcgcagcctccgcggacccgaggaccgccctgcgcgcagtctcgagcagcaaccagggtagcaccattgcgggccggcggccgccgcgctagtgaccacttcctcctactccttctcctcctgctccggcctcctggcgccctgctccaggctctccggcgccctccagccaggcaccggccgaaccgggtagtgccgcaagtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagag

SEQ ID NO: 197434 - DNA, 4622 bp, Homo sapiens
  Payload ID: 18941
  Gene Name: ubiquitin specific peptidase 46
  ENST ID: ENST00000451218
  CDS Start-End: 141-1160
ctccctctcccagccaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgtttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaacacctcttgaagctaatttattagaaaaaatatttcagttggaaggctgtagaagtaatgtttaaatgctaagtcataagttcaggatatttcttttctatttggttgtgcaaaatgtttttcccagttatttaatcgaagtaattccttttaatagaaagagtcagttaaaattcagcattcatggatagatttttggaacgaaaaagggtaagtataagaaaatattgcaaacacattaaaacagttgtatggtgcaggaaaagaagattggaaaaagaccaaaacacacttctccagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatg

SEQ ID NO: 197435 - DNA, 7954 bp, Homo sapiens
  Payload ID: 18941
  Gene Name: ubiquitin specific peptidase 46
  Uniprot ID: P62068
  ENST ID: ENST00000441222
  CDS Start-End: 186-1286
cgctccctccccgccctccccgcgccgccgcctcctcctcccggcctccctctcccagccaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaacacctcttgaagctaatttattagaaaaaatatttcagttggaaggctgtagaagtaatgtttaaatgctaagtcataagttcaggatatttcttttctatttggttgtgcaaaatgtttttcccagttatttaatcgaagtaattccttttaatagaaagagtcagttaaaattcagcattcatggatagatttttggaacgaaaaagggtaagtataagaaaatattgcaaacacattaaaacagttgtatggtgcaggaaaagaagattggaaaaagaccaaaacacacttctccagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatgggaattctctttctagagaattatatccgggtaatgctacacacatggacttaaaatcctttttataaagtgtgagtcagtggcaggtcttatgtccaagtaattattacaaacaattttgaagcagtggaaatgtacagaacattctgatcattataatatataaaggcagtattactctcaaggttgataaaaatcaatgttctggagataactcatcactttttttgagtgaaaaagatcaacagaatttaattcaggaaatggtatctggagaatagcaaattgagaatatcagtgaaaagaatttagggatagttaactaggcatcacagtgaatttatttttggggactttgcatataaaatccttttaaccagttatgaaatgaaagatccattccccaaataagaaggcagcttccagtatctggtttctaggaaggagtaggactgtgattggtccctggtgccctgacttctgggcctgtttctgagccatgggggaccccccagcttcagaaatactcacgtgggttcacaccactccctgccccagaaggagggcaggcacaggtccatgccatgtggcctcagtgaagcctacagtaactatgggtagggctgcttttccctgtcaatcacccagggcacctgtgggtggacagaagattgtcatcggaatacatgcttgggcccaattatgggaataaaacctcatagaccaagagcagggaatgtgccagtaagtgttgagtctcccagctgctgtccatcttctcggggcagtgcagttgaacctgactgagctggaacagagactgttgggaaggtcacttctgtctgccacgaaggccaaaggcagagaagaccttcttgggactgtgtttttctttcctaggcctcactttgtcctgggatttataggacaggcctgtcactaccaaggtgacacaaattctagagaatgtattttcccatttcttcaaatttcctttcctctctttttattgatacttaaaatacctttactaaaaaaatgaagccttccatttccattcccttatatttacatgaagataaaaatacttactaagtcgttgtatttgtccattctggcagtgctataaagacatacctgagcgtgggtcatttctgaagaaaagaggtttaattggctcatggttttatgggctgtacaggcttctgttctgggggaggcctcaggaaacttacaatcagcagaaggcaaagggaaagcaagcccatcttacatggcaggagcaagaggaagagagcaaagggggaggggttacacacttttctttccttttttttttttaagatggagtctcactgtcacccaggctggagtgcagtgatgagatctcagctcactgcaacctctgcctcccgagttcaagcgattcttctgcctcagcctcccaagtagctgggactacaggcatgtgccactatacccgggtaatttttgtattttcagtagatacaaagttttctcatattggccaagctggtctggaactcctgacttcaggtgcctcagcctcccaaagtgctgggattacaggcaagagccaccttgctcggctggggttacacacttttaaacaaccagatctcgtgagaactcagtcatgaggcagtactagggggatggtgcttaaccacctatgatgcaatcacctcccaccaggccccacctccaacactggggattacaattcaacatgggatttgggtggagacacagagccaaaccgtatcagtcatttttcttttactgaaggaaaattttggttgtggggttagtactaaagatagcccatgtagactttttctgaagataccccaagtggagagatttttaattaggcatttatttggcacctattgcattctaggcattgtgataggagctgggggataaaaaggtgacacagattgggtccctcttatggactcgttttttgtctcagaagacaagtctgggtgagaaagaaatttaaaatttaagttgtggaaataacacgtgtgggggaaactccttgcaattcagcacagtttggtattcagccccagcctcaacatgcagatggcactgttggatgaagccacaccatcttttttcctgggagccccacactcttcccagcctgccttctagctcagggacaacacattttgaaaaacaaagtataaatcgattatgttgcaacaatgaacttcacgttttgcctcttctcatgttaaaagagccagtatcatgaaagcctcaacagtgagctttatgaatcaaatatctgttatttctaaacaatctgtttacattatgaccaaataattagagcctatctagacttaccaaaataagatagggcataagcgatttattggtgcatcagcctttgtttgctttttaaggttcctttatgttttaaagggatttgaacaaaagacatcaggagcttacaaaggaaaaatagcttcattttggttatgagataccagagtcagaaatgacattagattgtatagaaaagacttctaattgtgtgcttacttcccacatgattataataaactatatattaacaaccttgggatcgtactcaggttgtcaattacacggatgcatctttcacttttttctttcccaagagtgagagaaagagtgaggttgtgcttaaggcagtgtggaattctacagaagctcttcttggaaaaggagttcaggcacttgtgttgtagactgcagtctgattctgttcttacttcctctcagcataagggagctttgaaaagaaaactcagacttgtatccgacttgaccagaagcaaaataacttgatcattgaagccactatttctgtgtatttgatcaagtcctcctctggaatccaatgcagccatattcatatttcggtctctcttaatggaccttgctggaaagaacattctgtgctaagaaaatggaaaataaacgtgagaaaactttaagaatgagccttcacacctcctgcagcaggtgatagctctgtacttcagagcttgtctccaggttgagaattacctgttttccactctgaggggattagaaagatactgttttaatgggttataaaacttgtgtgaagaagattggccttctccacctctcctgtgaaataaattgtttgaaaactc

SEQ ID NO: 197436 - DNA, 2437 bp, Homo sapiens
  Payload ID: 18941
  Gene Name: ubiquitin specific peptidase 46
  ENST ID: ENST00000503060
  CDS Start-End: 126-248
aaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatggaagaacctccagcccttgggtccccaggctggaccctgctggcgcctccacttgtcagagcctttggggagctcagattggagtaaggcattgctgtcccttgcagggtgtttaagggacagtggagatcatgccatttcagacctggtggaagcaaccactaatataaacacctcccatgtataggaaggctggagtgggaatccttaaccccgccccctgctcaggtcaatcccccacccaccgcccccactgtccctcccagtcttccttcccagaggagaaggctgggtatgaggaaactgctgtcttttcactggatcagacgtaaatattaactggacctctctttagattctttgctcaataatgaattgttttcagggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcac

SEQ ID NO: 197437 - DNA, 1419 bp, Homo sapiens
  Payload ID: 18941
  Gene Name: ubiquitin specific peptidase 46
  Uniprot ID: P62068
  ENST ID: ENST00000508499
  CDS Start-End: 281-1360
tgttatgtcatctaccaggtgtttaagggacagtggagatcatgccatttcagacctggtggaagcaaccactaatataaacacctcccatgtataggaaggctggagtgggaatccttaaccccgccccctgctcaggtcaatcccccacccaccgcccccactgtccctcccagtcttccttcccagaggagaaggctgggtatgaggaaactgctgtcttttcactggatcagacgtaaatattaactggacctctctttagattctttgctcaataatgaattgttttcagggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggc

SEQ ID NO: 197438 - DNA, 467 bp, Homo sapiens
  Payload ID: 18941
  Gene Name: ubiquitin specific peptidase 46
  ENST ID: ENST00000512656
  CDS Start-End: 217-387
gcaaccactaatataaacacctcccatgtataggaaggctggagtgggaatccttaaccccgccccctgctcaggtcaatcccccacccaccgcccccactgtccctcccagtcttccttcccagaggagaaggctgggtatgaggaaactgctgtcttttcactggatcagacgtaaatattaactggacctctctttagattctttgctcaataatgaattgttttcagggcaccaatgcctctgctctggaaaaagacattggtccagagcagtttccaatcaatgaacactatttcggattggtcaatgagttgtccactgaattggggccaagcgttactgaagggtgtctggggaaagtttggaaacacatgctactgtaactccgtgcttcaggcattgtacttctgccgtccattccgggagaatgtgttggcatacaaggcccagcaaaagaagaagg

SEQ ID NO: 197439 - DNA, 1589 bp, Homo sapiens
  Payload ID: 18941
  Gene Name: ubiquitin specific peptidase 46
  ENST ID: ENST00000514536
  CDS Start-End: 149-271
ctcccggcctccctctcccagccaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatggaagaacctccagcccttgggtccccaggctggaccctgctggcgcctccacttgtcagagcctttggggagctcagattggagtaaggcattgctgtcccttgcaggggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagaggttggtttgcagattattctccagtagtcatagagcatcagtagtatttcggagaatgtaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactct

SEQ ID NO: 197440 - DNA, 7775 bp, Homo sapiens
  Payload ID: 18942
  Gene Name: ubiquitin specific peptidase 47
  Uniprot ID: Q96K76
  ENST ID: ENST00000339865
  CDS Start-End: 764-4627
agaggggaaaagaacgtcaggagagtgaacgggagcaaataaaacgctgtccattctgactggaagggccagagccgtgtctaagggcgggggccgggaggtggcccgcggtggtgtctctaccaggacgaggcctggggtatctgaagaggggatgacgtccaggcgctttgctaaagggaagccagaagggtatgagttgctagggtcagagatggggctttcggctcgagtctttccctgcagggcagagagtccgaagagcccgagaaggcagggaggacagtgggcctggtccttccccggccggcagagggagtcccgagatggaacgtccagctctcctctaacgaaaagcgtttgcatggctgtctcgccaattctgtacctcccggggctgaggaagagccgaggtgactagaagctagcgacaagtgccggccacctccgacgccaggcgccgggcttggagcccgacgggccgaattctcgcgagagcggccgccgccatttttccattgattgcagcgggctgggggaggggccgacgacgaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctgtttggttctgatacaggcctgcttacttgggatgtagggttagtaaatggggtttctgctttaaaggactgacttgctatcacacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccttcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatctt

SEQ ID NO: 197441 - DNA, 7396 bp, Homo sapiens
  Payload ID: 18942
  Gene Name: ubiquitin specific peptidase 47
  Uniprot ID: Q96K76
  ENST ID: ENST00000399455
  CDS Start-End: 121-4248
attgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggatgtgttttggagatgcagacaaaatatctttgatgaaatgaagaagaaatttttacagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaaacaacaaaaaaagctaaccttctattagaaaaggggacaggggaatgagtaaacttcttttattgcggacaaatgtgcacatagccgctagtaaaactagcctcaaacaggatgctcatagcttaataataaaagctgtgcaaaggccatgaatgaatgaattttctgtttatttcactgatgcacacattacctcattgacaattcagaagtaaatccaacgtgtgttgactcttggaaagcagcaaaaacaggagctgaagaaaagaaattcttggaaccagccgtaacccagtaaggaattgtgaagttgtgtttttattttgtttcattttttgcagagtattaagaacattattctggaacatcagaacgtttcccttagaccgatcccagcaggtggcagctcagattgctgcagtgttgtaattataactgattgtacttaagttatggatgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaatttttttctctttgtacatctagttttgaagatttacttcaagtttgaatcttctagaatgcttgtaagtccagttttaatttttagagtcaatttgtagttacatgtagtttaacttttgggaaacgtcttaacattgttctgaataaacttgctaatgaggtcaggtcatggtacagactgatgcagtcaacatgatttcattgcagagtttattagtatcagcaagtttttgctttgctaaataaaagtactcaatgaacacaattctacataaattttgacataccatctaatttataaaaatcaataaaaaaggttttggtaaaactttttcatgccagatgctgtttacaacaatgaacatgccaataaaacatttgttcattctgttgtgttattttagtcattaaacttctgtggatgaagaatctgggttaagaatagatttgtcatctttaaatatgacattttgtaatgtgtattggatatctcatttctatgataaaggtatatttacagtaaagttctcataagagaaatgaaaagctgtgttaatatctaactttggggaaccctgtcagtatttcagatccgatttttaccctttttttcttataagaaagataaaattagaaaatactgttagcaaatgtggctctgccatttgaatataatcaccgagaattccatgtcttaaaagtctcctggaatccacaatgaaaaaaaaaatcttttctaaggtatttttctggctaatttttatttgaagaaagctatagcatttagcgaaatttgactgaagtaatgttctgagtttgcattagtgggattggtgatgttctcagaagaaaattggaaacacttgtgatgaattgtctttcagatcacttagattttctgatgtaagaggacagctgtttggttctgatacaggcctgcttacttgggatgtagggttagtaaatggggtttctgctttaaaggactgacttgctatcacacaaaagaggcagacttgtaaacacaatgggctttggagtttggtctgattgggtttggtttagtattcctatgagcgtaaatggtaaaattcttctgatacccactctttagactgtgccttctgctctgttctttgttttatgtttaactgctgtttctaattgcaggtgtattacagatacaaataagagtaaagaaaatatatttcattatagaaaagaaaaaattaaaagcttcttgcttttcagtgcctgatagagtgaaaacacaaagttgcactttaataatttcaataaaagctaatctgtgtcagcctccctctgcttcagagagtcaggtgagcatccataacctaacaggcagagccctagcgatgtggatcaagtttcctgagcccgggggcggtggagcctcatgatctcttatcttttgaggctgaggcaggtcacatgcaacaaattgtgaccctgctccccacaagtcatgcaaaggttttgaagagcttttaccgtggggcagatgaacttgtgtcaaccatgcacaccctgtgagaaccaagtacctgtgtttctaaggcgggcactcaaggtgaggggtgcattctggccaaagaaacaaaagctgtggtttcaggaccatgccgtgtgtagctgatctgtacgggacgtgtatgtaaggaagagcaatcatgatagataagaacagtgtgtgaagcagccttcacactagagtgtttggtcatctcttataatgtaagggaaggtactttaaaattctgggaagatgcgatgaactcatgtcccagtcagaaaataatccaatgaaataagcattggttgccaggccacagttaggaattgtattgtgatacatctagaggccaagagagcaggagagagctaccaacttacactgtggtttaagctaaatgaccgcacagcatcatagcattgcagtgttgttactaaatctggaagtgacctgtgaatgtatggaatacaataaagtcttttattctggttcatttgctagtacttcctttttgattggatactgtagttcttcctctggattttattttgttcagcgtcaaggccctaattttgcaaatgtagtctaaaccacattacgtggactagaggatactctgaattagcaagttttttgtttgctgaataaaactattccatctt

SEQ ID NO: 197442 - DNA, 4525 bp, Homo sapiens
  Payload ID: 18942
  Gene Name: ubiquitin specific peptidase 47
  Uniprot ID: Q96K76
  ENST ID: ENST00000527733
  CDS Start-End: 212-4279
gaaggcggctgtggtagcggcggcggcggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagagatagaaaatgctgctgaagaacctagagtcttatgtattatacaagatactactaattcaaagacagtgaatgaacggatcactttaaatttaccagcatctactccagtcagaaagctctttgaagatgtggccaacaaagtaggctacataaatggaacctttgacttggtgtggggaaatggaatcaatactgctgatatggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgggggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagatgtctggaatgtggttatgagggctggcgaatcgacacatatcttgatattccattggtcatccgaccttatgggtccagccaagcatttgctagtgtggaagaagcattgcatgcatttattcagccagagattctggatggcccaaatcagtatttttgtgaacgttgtaagaagaagtgtgatgcacggaagggccttcggtttttgcattttccttatctgctgaccttacagctgaaaagattcgattttgattatacaaccatgcataggattaaactgaatgatcgaatgacatttcccgaggaactagatatgagtacttttattgatgttgaagatgagaaatctcctcagactgaaagttgcactgacagtggagcagaaaatgaaggtagttgtcacagtgatcagatgagcaacgatttctccaatgatgatggtgttgatgaaggaatctgtcttgaaaccaatagtggaactgaaaagatctcaaaatctggacttgaaaagaattccttgatctatgaacttttctctgttatggttcattctgggagcgctgctggtggtcattattatgcatgtataaagtcattcagtgatgagcagtggtacagcttcaatgatcaacatgtcagcaggataacacaagaggacattaagaaaacacatggtggatcttcaggaagcagaggatattattctagtgctttcgcaagttccacaaatgcatatatgctgatctatagactgaaggatccagccagaaatgcaaaatttctagaagtggatgaatacccagaacatattaaaaacttggtgcagaaagagagagagttggaagaacaagaaaagagacaacgagaaattgagcgcaatacatgcaagataaaattattctgtttgcatcctacaaaacaagtaatgatggaaaataaattggaggttcataaggataagacattaaaggaagcagtagaaatggcttataagatgatggatttagaagaggtaatacccctggattgctgtcgccttgttaaatatgatgagtttcatgattatctagaacggtcatatgaaggagaagaagatacaccaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggtttagagctcagtattgacaggtttcgtctaaggaaaaaaacatggaagaatcctggcactgtctttttggattatcatatttatgaagaagatattaatatttccagcaactgggaggttttccttgaagttcttgatggggtagagaagatgaagtccatgtcacagcttgcagttttgtcaagacggtggaagccttcagagatgaagttggatcccttccaggaggttgtattggaaagcagtagtgtggacgaattgcgagagaagcttagtgaaatcagtgggattcctttggatgatattgaatttgctaagggtagaggaacatttccctgtgatatttctgtccttgatattcatcaggatttagactggaatcctaaagtttctaccctgaatgtctggcctctttatatctgtgatgatggtgcggtcatattttatagggataaaacagaagaattaatggaattgacagatgagcaaagaaatgaactgatgaaaaaagaaagcagtcgactccagaagactggacatcgtgtaacatactcacctcgtaaagagaaagcactaaaaatatatctggatggagcaccaaataaagatctgactcaagactgactctgatagtgtagcattttccctgggggagttttggttttaattagatggttcactaccactgggtagtgccattttggccggacatggttggggtaacccagtgacaccagcactgattggactgccctacaccaatcagaagctcagtgcccaatgggccactgttttgactcggaatcatgttgtgcactatagtcaaatgtactgtaaagtgaaaagggatgtgcaaaaaaataaaaaaaa

SEQ ID NO: 197443 - DNA, 4595 bp, Homo sapiens
  Payload ID: 18943
  Gene Name: ubiquitin specific peptidase 48
  Uniprot ID: Q86UV5
  ENST ID: ENST00000308271
  CDS Start-End: 650-3757
gctcgggaaaggggttcggaaccggtctaggctcaagttaaatctccctctaaagagccaacactggtttctttggcgactcggtttctactctaaacaggtcccgctccacagtctgggcgggcctgtgtgtgcgttgagtagcctctagcgtgaaaacttcatggttaaaagggaagtaccggaggcaagaaatagctttcgaggcactggtttgttagagtagtggtacgtagtgcgccgccctgaacgggggctgagacgctgcttttccagaagtgccagtgaggacgtggcaagaccgcctcggacgtacgcttcctctacctcagcccgtcgggttaggggcgcgggaggcgcagaggctgctgggaacgcgcatgcgctcagcgcggcggggagtccacctttaacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcaga

SEQ ID NO: 197444 - DNA, 570 bp, Homo sapiens
  Payload ID: 18943
  Gene Name: ubiquitin specific peptidase 48
  ENST ID: ENST00000374730
  CDS Start-End: 1-346
tcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctaggtaaaacctttaagttcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacg

SEQ ID NO: 197445 - DNA, 3037 bp, Homo sapiens
  Payload ID: 18943
  Gene Name: ubiquitin specific peptidase 48
  ENST ID: ENST00000374732
  CDS Start-End: 958-2523
aattgagatggtttactgtaaaattaaaatgggagttagttttctagacatgtaactctctggggagtataaaactggtcacaatgggctttgcgttgaagtatctgtccctcagatctcatcagaaggagtatataatacaaaaatataaattcaacctctgtatgttttcttctatgttttatgctgggactcactggagatctttgtaagtaatcaaagctggccctttatctttgattttggcttttagggaattctagggacttcctttccccaaattaaaactcattttgaggtgtttggttttgtcttttaatttttgcaacttcaaaattgatgactcagttctagtgtactttatcctcgaacttgtttaaaataggttactttcttgaaataaataataatataatgaagagatcatgacttggatttgggtgggggaattaaataccttttcaaaattgccatcagtatcatcttggatgaagaaagttcagtggttaaaagcgtcttctgaagtgtggtcatagtcggtgaggtttatttcagtttggcttctcattttaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatgtatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttg

SEQ ID NO: 197446 - DNA, 4309 bp, Homo sapiens
  Payload ID: 18943
  Gene Name: ubiquitin specific peptidase 48
  Uniprot ID: Q86UV5
  ENST ID: ENST00000400301
  CDS Start-End: 239-3190
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcagactgaagtacatttggataacacaaggtttctataaaatttgttcttcctgtcctccatgtcactgtttcttggacctcagttctctttttgaaagcattattccaaaatgccctgagagggtctcttagatcattgtttaaaaaaggaaaaaagtatatggatgtgctgtccatccaactcaggattatcattcttagcaacacgtaaccgaagcaatattcttaagaatattgaaggggtttttttaattgaacttaagactggagtttttcctttgaaa

SEQ ID NO: 197447 - DNA, 2818 bp, Homo sapiens
  Payload ID: 18943
  Gene Name: ubiquitin specific peptidase 48
  Uniprot ID: Q86UV5
  ENST ID: ENST00000421625
  CDS Start-End: 650-2107
gctcgggaaaggggttcggaaccggtctaggctcaagttaaatctccctctaaagagccaacactggtttctttggcgactcggtttctactctaaacaggtcccgctccacagtctgggcgggcctgtgtgtgcgttgagtagcctctagcgtgaaaacttcatggttaaaagggaagtaccggaggcaagaaatagctttcgaggcactggtttgttagagtagtggtacgtagtgcgccgccctgaacgggggctgagacgctgcttttccagaagtgccagtgaggacgtggcaagaccgcctcggacgtacgcttcctctacctcagcccgtcgggttaggggcgcgggaggcgcagaggctgctgggaacgcgcatgcgctcagcgcggcggggagtccacctttaacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctgatttcttagaaatatcccacataatccagcttatcccttttctgtatatgtttattcaggtttacctgatgtctcaaaatgaaaccaaattaagcctttttaaaggctgatgtgccatttgtattaagttatctttgtcattttaaagacatgaattccccaagcctaattcctacttaaggaagagagacaatttagtccttactttagaaaataaatacttaagcataa

SEQ ID NO: 197448 - DNA, 549 bp, Homo sapiens
  Payload ID: 18943
  Gene Name: ubiquitin specific peptidase 48
  ENST ID: ENST00000526044
  CDS Start-End: 144-549
aagaatgtccagattatattaaataccatagaggttttatatccaccagcatccttttcaaggataactgaacagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactg

SEQ ID NO: 197449 - DNA, 3228 bp, Homo sapiens
  Payload ID: 18943
  Gene Name: ubiquitin specific peptidase 48
  Uniprot ID: Q86UV5
  ENST ID: ENST00000529637
  CDS Start-End: 35-3178
gtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatgctgttttttttttttccaaatatatttttttaaactcaggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagt

SEQ ID NO: 197450 - DNA, 554 bp, Homo sapiens
  Payload ID: 18943
  Gene Name: ubiquitin specific peptidase 48
  ENST ID: ENST00000527823
  CDS Start-End: 411-554
attccgctgggggatccggaaggaatggaagtcatggtctctggctttggagcttaaagtctagtatgagaagtgaaataagttagggagtttctataaagcaaacgaataagtccaagctctgggcgtctgtctcacaaggagggtaaatctgactttaacaacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggac

SEQ ID NO: 197451 - DNA, 566 bp, Homo sapiens
  Payload ID: 18943
  Gene Name: ubiquitin specific peptidase 48
  ENST ID: ENST00000534705
  CDS Start-End: 127-566
agattatattaaataccatagaggttttatatccaccagcatccttttcaaggataactgaacaggtcttgttttatagtaggcatttttaacaattctattttcttctgtactactatttccattatgtttaccctacagaattttattctaatggaatatacagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatc

SEQ ID NO: 197452 - DNA, 680 bp, Homo sapiens
  Payload ID: 18943
  Gene Name: ubiquitin specific peptidase 48
  ENST ID: ENST00000532737
  CDS Start-End: 565-680
atgcgctcagcgcggcggggagtccacctttaacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatc

SEQ ID NO: 197453 - DNA, 3177 bp, Homo sapiens
  Payload ID: 18944
  Gene Name: ubiquitin specific peptidase 49
  Uniprot ID: Q70CQ1
  ENST ID: ENST00000373006
  CDS Start-End: 223-2145
cgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtgcgtgcgctttactctgtggggtgggggacacggaaaggggttgatttgtccacattttattgttttccttttatttccatcccatggattacctagagggaaattacatacatcaaaaatccagtggaaagaattgtgaaaattgggttgggcgccgtggctcacacctgtaatcctagcgctttgggaggccgcggtgggtggatcacctgaggtcaggagttcgagaccagcctggccaacatggttaaaccccgtctctactaaaatagtacaaaaattagccgggcgtggtggtgggcactggtaatcccaggtactcaagaggctgaggcaggagaatcgcttgaacctgggaggcagaggttgcagtgagccaagattatgccactgcacttcagcctgggtgacagagcaagactcttatctcaaaaaaaataaaaagaattatgaaagttggattcaaattttgggtatattactaagtaacaacatatggttgttctaagaattaaaaggaactgacatgtaaaagtgcttagaacaggacctaggccctgtgcaatggctcacacctgtaattccaacactttgggaggcagaggcgggaggattgcttgaggccgagggttcaagactagcctgggcaacatagcgagactgcatctctacaaaaaatttaaaaattatccaggtgtaatggtgtgcacctgtgatcctagctacttgggaggctgaggtgggagaattgctcaagcccaggagtttgaagttgcaatgagctatgatttcaccactgcattctagcctgggcaacagagtgagatcctgactcaaataaataaataagaagagcagttgcctaccacatagtacttattcagtcagtgttagaggatattgtagtattatcaaaagtattggttattgataatattactgttttgtggtaatgctacttctgcacaccccagtttccttcttggttatgcagaaacagtagaacctgtgtaacctcaaggagatattgtatgaatctcactagccgcagcttataataaagccgagaacattta

SEQ ID NO: 197454 - DNA, 8804 bp, Homo sapiens
  Payload ID: 18944
  Gene Name: ubiquitin specific peptidase 49
  Uniprot ID: Q70CQ1
  ENST ID: ENST00000373009
  CDS Start-End: 103-2169
gtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtttttgggtccactgcaatgactcaaagctgaatgtatgcagtgtcgaggaagtgtgcaaaacccaggcctacatccttttttacactcaaagaacagtgcagggcaatgcaagaatctcagaaacccatctccaagctcaggtgcagtccagcaacaatgatgaaggcagaccacagacattttcctgaatgggaggcatgtatcaaagactggcttttgtgtattggtgtccatacatctttcctcttataggaaataaggctactgcaggaacagattactaggtttgccttgctgggtctagagtagaaggtgccaggtgattcgtgtcctgtcgtaaattttatagtctctttcttttgaatgagtttgggagttccctcctttcctaaaaacaaaagaagtaacttctatgaagatcctttcatcagttgcttctgaatatagagggatctgggtggaggaaagcggggcgggggggtaaatcaatcatatccacacaggagagcagccatgttttctctccatgatgtgattcccctgctaatcaggacctccttgcagcaccagaagaaccctccggatgtgagcagtcctggacagagcacgtgaggaggggccctgggctagcagtttgctggatgggattggctccaagatgggagatgaagtctaaagggtttattcccacaaaggaagtaaccttcaagggtttaaaacaaacttccttttttggggatagcagctgaagagtggagtgagatgcatggaacaaatttccccatgcaaagtgggatggttttcatatgtcataccctccctacttgctgctgtcatataatcattccatacttctgagactggcatgaataccccttcattctaaagaaggggcaggtcatataaagaagcaatagactagcacatgttccatgctgagccaaaggacactcctggctatctcagttctgtagcagatccctggttcaggtctagggcaagcacatggtttggtttaaattgattcttaggttttctcagaactcaattgagggtgggcagagatagctgatgctccagggcttattgaaggcctgtcacccgttctcacttcagtgcggcatgcagcttcttagcctgcagcttctttcttgctcctggagagctagaacattcatgttcacagggtttgggagcttttggttctctagggtatgttaactgcttaggagtccacctcgtacatatctgaagagttgattaccaatggccttgacctgtttcctcccaaatctgataatccctactgttgctttaccccccatactcagtccatcagagaaaaaaacaagagtgccccgtcctttcccccagtgctagtaaaatacatcttcctttttaaattgggtcagtttctaaacagaatgaaattgcccagataaaaacccttgtccccatcaggcaccacttcattcttagttcttcacttagatttgctggtgaaagtgaatgcaaaccctaacttttgttgctgtggtcactgcagtgagcctcactcaacctgtcactatgaatgctcatcttttgactgagtatatcatattaatgtttgaattcaggtagaagtacagttgtcacttgaagggagtagatgtggaagggcgttcggggaggagtgggaagtggggaaagccaggctaaagaatgagggttatagctttagcaatgttgatgagccacatttcccacacagatctgtagcatttgctgttgacctcttttgagatgaactctcccataggccctgccaggcagcactgagacatggaggaaattcagacaaaaaatggctcaccctgatagggaaggagtgactatattttaaattaaacttgctttttccaacactgtgaggtttctgtaatatttagcttttatttggaagcgatagcgtatggcattttttatgctgtttggtttatattgtctactgcaggcttctttgtataagctttgcctgggctcaccctctcctggacactgttttaaagtgtcaccgctgtccatgctgccagaggctctgatgtgaagctgtactctcaagatccacgtttttaagtcggcatgattagtaatgactttttgtggcaatagaaaagcccattaactcaaaaaaaccaaggagagtaaaaaggaaaggaaactatgaatcgtgcctcatctttcattgaatcctatatttattattctagaaaaaaagaacttacaagatagagaagaactaatagagcatctactttacccctcaggctgtccagtggggataattattaataaacatttaatggaaaattcaaagatcttccaatttaatttttaaaaatagttttataccaaatattataaggatttattaagcagattaaggactttgtgaaataagtgcttaacttagctgagcacgcatatatcaaagtaataaaagaaactaacatcagagtctccactgagctacacatttgtgaaaggtgcccactgcagttacagacacctcaggtacccagaggcggcagcactggacacttaggacgttagtatttaaggagatttttattaaagaagagttccctgctgcataagccaatggctattgtgagggaaatgtccctttgcctttaatttatttacgtactgggtatagatgaatgtctcagttgcatctgaaattgaatcattctaaagagaagaaaataagaaccaggtaaaaactgactagatgctgccaaatcaaacccaaggtctcctaaccgaaccttaatgggcctgcttctctcccagggcaagtagttaagagtctcattccaggaaccctttgtagttagttggctggcatgtttacttgctgctgtagccagccaagatgagtgcacctaggccctcaaaaaggatttttttttacctcaatctagcctgaccctcatatctgtggttgcctctgagacgaacatccatgctagtataaaaatagttaggaatgcccttggcagaactgaagctcttattaaatggtggacagagctcttgccagctttgatccagcccctcagtctcggagttatggggcagggttggggggcagtgctacactgtaaagaatttccaggctgggcgcggtggctcatgcctgtaatcccagcactttgggaggccgaggagggcggatcacaaggtcaagagattgagatcatcctggccaacatggtgaaactccgtctctactaaaaatacaaaaattagctgggcatggtggcacgtgcctgtagtcccagctacttgggaggctgaggcaggagaatcgctggaacccaggaggcagaaggggcagtgagccgagatcgtgccactgcactccagcctggcgacagagcgagactctgtcttaaaaaaaaaacaaaaacaaaaacaaaaaaaaaaaaagaatttccagatgtctcttaaaatgtcatgaataaaattggaaactgtagaagtgttaatgtgtcctatggactcaatagcagagtttatttttgtttttaatggcaaggcttctagagtcaatgattgtatgagtttgctactctggctgtgcttacagcttcatccaagtacaagggaagaaccaatgaggtggattggctgacagtggggcatgccccagcataagccctagagaggtcgacagtagtgcagaatgaaaacttggtcggggatggcgggtggtgggtgggaggagggtgggctggccgggagggagaaatggagtttgttctacttactgataaagctttgtgaactaattttatacaattcataaaatttggtgccttgtactcaattacggtttgcatggaattgaaaagattaagggaaaggatttcttcttgtcatttcaagtggcaaatgggtctgtgtagtgtttaaaggacatctggtatcacagacttttaaaaagcatttcatgtctcttgtgtgtgaatgcaaattattcttaccagcaagttctgaaattatgttacaatgtccaaattctttgtatttgtgactgttcatcaaatggctgcttttcaaggcagactgtgtactccattgtttttcacttcccttgtcatgttccatacattgacttgggcctttttaaatcaggctggggggctaccccttcttaaatgaatactatatccctatctgaggttacctcttgtgagtggaagggttgctttcccaggtggttgggagagcacaaatgttgagaaaaggccttttagtctttatcaaaacaatgactaatgctgggcaacatatagcagaagtcaaacaaaaatgattcctcctgaaatggtaccttcattggttctgatgttcttttgcaaaaaatgtccggaagcagtatagaaaaccccctgtatgtgaaccttagattgtaaggcaagccagtgcactgtgtaatatgcaaagggagtggtgcaaaagagaaggcacccgtcccagctctccatgccctttccctggcaggcgctgactgagatggcgctgagtgaatgtggaaggtgctaagacccagtctcttcactgcagggctgtttacagccagtttcttttactctgaccttaaggtttccactgagctcatgaaacttcaacatatggtgtttaaaagtttcccactcaaatgcacacttgaaaattgggtccctcagcctcattactgaactaaataagtgaagaagttgtatctttggggtaaaactttccagggccacttaattttttaaccagttaagtacgcatcttcctggtggttcagactttttaagtcagtgctaaagctgaaaagcgccttctaaatatgactgtgagtttagtttgtatcttacatttagtaactgttctgttgggccaggactatgactttaattactatgtacttattcatcccacactctgcactaaatacaccatagctactatagcattgtggcaggcactcatttttgtggactcattccatacttctgctggcatatttcgtttaaaatctagctaaagattttcatagtactgtgttaactagccagggctgaaaagtgtgacaggatatcaaattgactttccttggggaaaatgttgctttggcaatagtgaagtccaactccttcatttacagaattagtgattactcatcaatttttgaaagttgtagattaagtagttttatttactaaattcttaaccactttgaagatttaagccagttgaaatgaaacattggctggatgcagttggctagcacctgtaatcccaacactttgggaggccaaggtgggaggattgcttgaggccaggagctcaagaccagcctgggaaacatagatttgaaatcttttcaaaaatgtataaaaatttaataaataaataaatgaatccttactcaaccataattatggctttaaaacccaaccaacagtaaacacttacttgaagccaaaacagtaaattttgaatgaaatttgaattatgcttttggaagctgccatgtcttaattcttgctggattttgattttcaattttggaagtttttatcaaaactgtccagtcatgagtatatcaggtagcagcctttaaggatctaagtttcattcctataaagaacaggaggtgctggtatttcttgtcttagcaagtgatctgatgcaggtctaaatgggggttagcatctatactatggcttaaaagtttcctccttggtcaccatttgggaggtgatggcttcaaagctaagctttgctctcatgtgacccttctttatcttaatacccaataagatataaacctctcagagtcaacccagtgtagactcaaagggtcttagcttcatctatcagataagatctatctgatttatacaaagaatggtgctgtttttatatacatactaaaaaaatctaattctcaaacaattttcttaatatttatgccagcaaggtcaggaaagactattttgtcctgtttaactttagtagtgaacaaactgctagagacatctgtcatccttaacaggccactgtggtccttatatactgaccctcctttccaattaacgtcctttaatcccatactagttccataagagacttggcacataaaagcagtattttttttaatgcctagtaaactggccagaaaaaaatattgccatggtggacctgtttctatccacctctttctatggctatataagtctatacatgccagttccgtacatactccatttccaaagagcccccaaaccctggacagtagcactaccatgaattttagggtcacaaaacatttccttctgaaggaagcagctgcctcagcagtgtcactttagtgaccactgcccaggcttacttcactttgcctccccctacacatcactgccctctttctgccaccaaacctcactattccagcaatgatgcctccctggtgtctggaaaacccatctggtgcactaaaatgctatgcaacaccaaatggcttcttcccctaatattgctcaacaatgtaaattcttcaagaataaacttcatgctaggttaacatcaatgtatggttacagcttccttttttttttttcccttttaaaatgaagcaaaccacctccattaaaatccatgttttggggcttgtttttgtctctcaagtgtgaaatataaatcatgtttttatgatttttgtaaatctttttacaccttgtttttgtaagcaaaagtttcttattaaaagaataaaatg

SEQ ID NO: 197455 - DNA, 2446 bp, Homo sapiens
  Payload ID: 18944
  Gene Name: ubiquitin specific peptidase 49
  ENST ID: ENST00000373010
  CDS Start-End: 496-2253
agtgcttcttttgctgggcaaattgtgtgaaagatgggagggcagcactgttgctattatggatattaacttatcaggacaataaggtcaaagtccctgttagagctaattagattctccttgacaaaaattggaggtagcaacaaagaaaatcaatgctgtgaagtagattagaaaacaggctcggagaagttaaggaaggtcttgtaataaatggacaccatgatgttgactggtctctgttactccacatcatgtgctcttcttgcatgagccagacagcccctgagagttcagcatgtttcagtaacaggatcttgacagccagccattctgcagcaaaccacctactccaaggggactggacatgagtgatgggagcccatattatgggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtttttgggtccactgcaatgactcaaagctgaatgtatgcagtgtcgaggaagtgtgcaaaacccaggcctacatccttttttacactcaaagaacagtgcagggcaatgcaagaatctcagaaacccatctccaagctcaggtgcagtccagcaacaatgatgaaggcagaccacagacattttcctgaatgggaggcatgtatcaaagactggcttttgtgta

SEQ ID NO: 197456 - DNA, 9034 bp, Homo sapiens
  Payload ID: 18944
  Gene Name: ubiquitin specific peptidase 49
  Uniprot ID: Q70CQ1
  ENST ID: ENST00000394253
  CDS Start-End: 331-2397
gggccccagaatttaaaggatgagatggggagtaagggaagagagggggctaagagaagctgggggagtcctgatggatgtagaactggggtagactgcaggggggtgggaatcgaatgtgcgtgttatggggagttgctccagaaggtctgcaagggtcagggcagaaatgctgtagtgaaagatcaagtgtaagagagcctttggtgcagaagacgaggaaccatggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctccactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtttttgggtccactgcaatgactcaaagctgaatgtatgcagtgtcgaggaagtgtgcaaaacccaggcctacatccttttttacactcaaagaacagtgcagggcaatgcaagaatctcagaaacccatctccaagctcaggtgcagtccagcaacaatgatgaaggcagaccacagacattttcctgaatgggaggcatgtatcaaagactggcttttgtgtattggtgtccatacatctttcctcttataggaaataaggctactgcaggaacagattactaggtttgccttgctgggtctagagtagaaggtgccaggtgattcgtgtcctgtcgtaaattttatagtctctttcttttgaatgagtttgggagttccctcctttcctaaaaacaaaagaagtaacttctatgaagatcctttcatcagttgcttctgaatatagagggatctgggtggaggaaagcggggcgggggggtaaatcaatcatatccacacaggagagcagccatgttttctctccatgatgtgattcccctgctaatcaggacctccttgcagcaccagaagaaccctccggatgtgagcagtcctggacagagcacgtgaggaggggccctgggctagcagtttgctggatgggattggctccaagatgggagatgaagtctaaagggtttattcccacaaaggaagtaaccttcaagggtttaaaacaaacttccttttttggggatagcagctgaagagtggagtgagatgcatggaacaaatttccccatgcaaagtgggatggttttcatatgtcataccctccctacttgctgctgtcatataatcattccatacttctgagactggcatgaataccccttcattctaaagaaggggcaggtcatataaagaagcaatagactagcacatgttccatgctgagccaaaggacactcctggctatctcagttctgtagcagatccctggttcaggtctagggcaagcacatggtttggtttaaattgattcttaggttttctcagaactcaattgagggtgggcagagatagctgatgctccagggcttattgaaggcctgtcacccgttctcacttcagtgcggcatgcagcttcttagcctgcagcttctttcttgctcctggagagctagaacattcatgttcacagggtttgggagcttttggttctctagggtatgttaactgcttaggagtccacctcgtacatatctgaagagttgattaccaatggccttgacctgtttcctcccaaatctgataatccctactgttgctttaccccccatactcagtccatcagagaaaaaaacaagagtgccccgtcctttcccccagtgctagtaaaatacatcttcctttttaaattgggtcagtttctaaacagaatgaaattgcccagataaaaacccttgtccccatcaggcaccacttcattcttagttcttcacttagatttgctggtgaaagtgaatgcaaaccctaacttttgttgctgtggtcactgcagtgagcctcactcaacctgtcactatgaatgctcatcttttgactgagtatatcatattaatgtttgaattcaggtagaagtacagttgtcacttgaagggagtagatgtggaagggcgttcggggaggagtgggaagtggggaaagccaggctaaagaatgagggttatagctttagcaatgttgatgagccacatttcccacacagatctgtagcatttgctgttgacctcttttgagatgaactctcccataggccctgccaggcagcactgagacatggaggaaattcagacaaaaaatggctcaccctgatagggaaggagtgactatattttaaattaaacttgctttttccaacactgtgaggtttctgtaatatttagcttttatttggaagcgatagcgtatggcattttttatgctgtttggtttatattgtctactgcaggcttctttgtataagctttgcctgggctcaccctctcctggacactgttttaaagtgtcaccgctgtccatgctgccagaggctctgatgtgaagctgtactctcaagatccacgtttttaagtcggcatgattagtaatgactttttgtggcaatagaaaagcccattaactcaaaaaaaccaaggagagtaaaaaggaaaggaaactatgaatcgtgcctcatctttcattgaatcctatatttattattctagaaaaaaagaacttacaagatagagaagaactaatagagcatctactttacccctcaggctgtccagtggggataattattaataaacatttaatggaaaattcaaagatcttccaatttaatttttaaaaatagttttataccaaatattataaggatttattaagcagattaaggactttgtgaaataagtgcttaacttagctgagcacgcatatatcaaagtaataaaagaaactaacatcagagtctccactgagctacacatttgtgaaaggtgcccactgcagttacagacacctcaggtacccagaggcggcagcactggacacttaggacgttagtatttaaggagatttttattaaagaagagttccctgctgcataagccaatggctattgtgagggaaatgtccctttgcctttaatttatttacgtactgggtatagatgaatgtctcagttgcatctgaaattgaatcattctaaagagaagaaaataagaaccaggtaaaaactgactagatgctgccaaatcaaacccaaggtctcctaaccgaaccttaatgggcctgcttctctcccagggcaagtagttaagagtctcattccaggaaccctttgtagttagttggctggcatgtttacttgctgctgtagccagccaagatgagtgcacctaggccctcaaaaaggatttttttttacctcaatctagcctgaccctcatatctgtggttgcctctgagacgaacatccatgctagtataaaaatagttaggaatgcccttggcagaactgaagctcttattaaatggtggacagagctcttgccagctttgatccagcccctcagtctcggagttatggggcagggttggggggcagtgctacactgtaaagaatttccaggctgggcgcggtggctcatgcctgtaatcccagcactttgggaggccgaggagggcggatcacaaggtcaagagattgagatcatcctggccaacatggtgaaactccgtctctactaaaaatacaaaaattagctgggcatggtggcacgtgcctgtagtcccagctacttgggaggctgaggcaggagaatcgctggaacccaggaggcagaaggggcagtgagccgagatcgtgccactgcactccagcctggcgacagagcgagactctgtcttaaaaaaaaaacaaaaacaaaaacaaaaaaaaaaaaagaatttccagatgtctcttaaaatgtcatgaataaaattggaaactgtagaagtgttaatgtgtcctatggactcaatagcagagtttatttttgtttttaatggcaaggcttctagagtcaatgattgtatgagtttgctactctggctgtgcttacagcttcatccaagtacaagggaagaaccaatgaggtggattggctgacagtggggcatgccccagcataagccctagagaggtcgacagtagtgcagaatgaaaacttggtcggggatggcgggtggtgggtgggaggagggtgggctggccgggagggagaaatggagtttgttctacttactgataaagctttgtgaactaattttatacaattcataaaatttggtgccttgtactcaattacggtttgcatggaattgaaaagattaagggaaaggatttcttcttgtcatttcaagtggcaaatgggtctgtgtagtgtttaaaggacatctggtatcacagacttttaaaaagcatttcatgtctcttgtgtgtgaatgcaaattattcttaccagcaagttctgaaattatgttacaatgtccaaattctttgtatttgtgactgttcatcaaatggctgcttttcaaggcagactgtgtactccattgtttttcacttcccttgtcatgttccatacattgacttgggcctttttaaatcaggctggggggctaccccttcttaaatgaatactatatccctatctgaggttacctcttgtgagtggaagggttgctttcccaggtggttgggagagcacaaatgttgagaaaaggccttttagtctttatcaaaacaatgactaatgctgggcaacatatagcagaagtcaaacaaaaatgattcctcctgaaatggtaccttcattggttctgatgttcttttgcaaaaaatgtccggaagcagtatagaaaaccccctgtatgtgaaccttagattgtaaggcaagccagtgcactgtgtaatatgcaaagggagtggtgcaaaagagaaggcacccgtcccagctctccatgccctttccctggcaggcgctgactgagatggcgctgagtgaatgtggaaggtgctaagacccagtctcttcactgcagggctgtttacagccagtttcttttactctgaccttaaggtttccactgagctcatgaaacttcaacatatggtgtttaaaagtttcccactcaaatgcacacttgaaaattgggtccctcagcctcattactgaactaaataagtgaagaagttgtatctttggggtaaaactttccagggccacttaattttttaaccagttaagtacgcatcttcctggtggttcagactttttaagtcagtgctaaagctgaaaagcgccttctaaatatgactgtgagtttagtttgtatcttacatttagtaactgttctgttgggccaggactatgactttaattactatgtacttattcatcccacactctgcactaaatacaccatagctactatagcattgtggcaggcactcatttttgtggactcattccatacttctgctggcatatttcgtttaaaatctagctaaagattttcatagtactgtgttaactagccagggctgaaaagtgtgacaggatatcaaattgactttccttggggaaaatgttgctttggcaatagtgaagtccaactccttcatttacagaattagtgattactcatcaatttttgaaagttgtagattaagtagttttatttactaaattcttaaccactttgaagatttaagccagttgaaatgaaacattggctggatgcagttggctagcacctgtaatcccaacactttgggaggccaaggtgggaggattgcttgaggccaggagctcaagaccagcctgggaaacatagatttgaaatcttttcaaaaatgtataaaaatttaataaataaataaatgaatccttactcaaccataattatggctttaaaacccaaccaacagtaaacacttacttgaagccaaaacagtaaattttgaatgaaatttgaattatgcttttggaagctgccatgtcttaattcttgctggattttgattttcaattttggaagtttttatcaaaactgtccagtcatgagtatatcaggtagcagcctttaaggatctaagtttcattcctataaagaacaggaggtgctggtatttcttgtcttagcaagtgatctgatgcaggtctaaatgggggttagcatctatactatggcttaaaagtttcctccttggtcaccatttgggaggtgatggcttcaaagctaagctttgctctcatgtgacccttctttatcttaatacccaataagatataaacctctcagagtcaacccagtgtagactcaaagggtcttagcttcatctatcagataagatctatctgatttatacaaagaatggtgctgtttttatatacatactaaaaaaatctaattctcaaacaattttcttaatatttatgccagcaaggtcaggaaagactattttgtcctgtttaactttagtagtgaacaaactgctagagacatctgtcatccttaacaggccactgtggtccttatatactgaccctcctttccaattaacgtcctttaatcccatactagttccataagagacttggcacataaaagcagtattttttttaatgcctagtaaactggccagaaaaaaatattgccatggtggacctgtttctatccacctctttctatggctatataagtctatacatgccagttccgtacatactccatttccaaagagcccccaaaccctggacagtagcactaccatgaattttagggtcacaaaacatttccttctgaaggaagcagctgcctcagcagtgtcactttagtgaccactgcccaggcttacttcactttgcctccccctacacatcactgccctctttctgccaccaaacctcactattccagcaatgatgcctccctggtgtctggaaaacccatctggtgcactaaaatgctatgcaacaccaaatggcttcttcccctaatattgctcaacaatgtaaattcttcaagaataaacttcatgctaggttaacatcaatgtatggttacagcttccttttttttttttcccttttaaaatgaagcaaaccacctccattaaaatccatgttttggggcttgtttttgtctctcaagtgtgaaatataaatcatgtttttatgatttttgtaaatctttttacaccttgtttttgtaagcaaaagtttcttattaaaagaataaaatgac

SEQ ID NO: 197457 - DNA, 480 bp, Homo sapiens
  Payload ID: 18944
  Gene Name: ubiquitin specific peptidase 49
  ENST ID: ENST00000448078
  CDS Start-End: 1-157
ggaactcgagtctgagggcaccacacgccggatcctcatccccttctcccagaggaagctcaccaaacaggtcttaaaggtggtgaataccatatttcatgggcagctgctcagtcaggcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtttttgggtccactgcaatgactcaaagctgaatgtatgcagtgtc

SEQ ID NO: 197458 - DNA, 752 bp, Homo sapiens
  Payload ID: 18944
  Gene Name: ubiquitin specific peptidase 49
  ENST ID: ENST00000423567
  CDS Start-End: 708-752
attctgtaaagtgagggagggcaaatgagacctggactggaaccaggtggagtcaggaataagagtgtggtggaagggcgaaaggaaacagataagagatgggtgtctgtaggacgattctgggaccagaagagctgaaaggagactagagttagggtgtaagaagtgatggccatctgggacaaggataactgggtaattacgttaattgaagaggttcagcaagatccaaggtgaaaacagtgaggtaaagagacagggctaaaagcaaatggtgagaggagcaggaagagatgggccccagaatttaaaggatgagatggggagtaagggaagagagggggctaagagaagctgggggagtcctgatggatgtagaactggggtagactgcaggggggtgggaatcgaatgtgcgtgttatggggagttgctccagaaggtctgcaagggtcagggcagaaatgctgtagtgaaagatcaagtgtaagagagcctttggtgcagaagacgaggaaccatgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggac

SEQ ID NO: 197459 - DNA, 3181 bp, Homo sapiens
  Payload ID: 18945
  Gene Name: ubiquitin specific peptidase 5 (isopeptidase T)
  Uniprot ID: P45974
  ENST ID: ENST00000229268
  CDS Start-End: 53-2629
gggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaaggtagccttggtttctatggcaacgaagacgaagactccttctgctcccctcacttctcctctccgacatcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggct

SEQ ID NO: 197460 - DNA, 3083 bp, Homo sapiens
  Payload ID: 18945
  Gene Name: ubiquitin specific peptidase 5 (isopeptidase T)
  Uniprot ID: P45974
  ENST ID: ENST00000389231
  CDS Start-End: 33-2540
ccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagt

SEQ ID NO: 197461 - DNA, 438 bp, Homo sapiens
  Payload ID: 18945
  Gene Name: ubiquitin specific peptidase 5 (isopeptidase T)
  ENST ID: ENST00000542087
  CDS Start-End: 28-438
gtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagtacacccagcgagttgactacatcatgcagctgcctgtgcccatggat

SEQ ID NO: 197462 - DNA, 580 bp, Homo sapiens
  Payload ID: 18946
  Gene Name: ubiquitin specific peptidase 50
  ENST ID: ENST00000529349
  CDS Start-End: 1-258
ttttttcaacaagacgcactgacctggaacaacgaaattcactgctccttttgtgaaaccaagcaagaaactgctgtgagggccagtatttccaaagcaccaaaaataattattttccacctaaaaagaagcatgaggagatttgtctctaatatttaccgtgcgagtgtggttgggctcctggaaggaaaattcacaaagtgtggtccccctgtgactggattctttggagtttttaactctcagactctgcactgagcctctagcaattcatcaattacagttcaggttttcctacgcagacctgttccctcagaggtttctgctcggcagttttggctctggtttgacattcagggtacaacaaaaaggaagctgagaacggatattcattacccactcactaacttggacctcactccttatatttgctcaattttccggaaatatcctaaatacaacctctgtgcagtggtgtttcgctcttgtctcgaactcatgacctcaggtgatccacctccctcatcctcccaaagtgctgggattacaggtgtgagctaccgcgccaagcatacttttt

SEQ ID NO: 197463 - DNA, 1386 bp, Homo sapiens
  Payload ID: 18946
  Gene Name: ubiquitin specific peptidase 50
  Uniprot ID: Q70EL3
  ENST ID: ENST00000532404
  CDS Start-End: 175-1179
aagttggagtggtgcctgatacaggtgaaaatcagttcgcagctactggaagagagaggagcatatcaattgtttaaaacaaaaagccagcgttaacaggctcagagaaatgaagttgaaaggaatagatgtagctcctgaatagaagcaaaagtccaacgtggttccattaaaatgacttctcagccgtctctccctgcagatgacttcgatatctaccacgtccttgcagagtgcacagattactatgatacccttccagttaaggaggctgatgggaaccagccccattttcagggtgtcactggcttgtggaacttgggcaacacatgctgcgtgaatgccatctcacagtgtctctgcagcatcttgccgctggtggaatactttctcaccgggaagtatatcaccgctctgcaaaacgattgcagtgaagttgccactgcttttgcctatctgatgacagacatgtggctgggagactcagactgtgtctcaccagaaatattctggtcagctcttggcaacctctacccagcatttacgaaaaagatgcaacaagatgctcaggaattcttgatttgtgtcctaaatgaacttcatgaagctctaaaaaagtaccactactcccggagaagatcatatgagaaaggatctactcagagatgctgcaggaagtggattaccactgagacatccatcatcacccagctgtttgaagagcagctcaattatagcatcgtatgtttaaagtgtgagaaatgcacctacaagaacgaagtcttcactgtcttctcactccccattccatccaaatatgaatgctcccttcgggactgtctccaatgtttttttcaacaagacgcactgacctggaacaacgaaattcactgctccttttgtgaaaccaagcaagaaactgctgtgagggccagtatttccaaagcaccaaaaataattattttccacctaaaaaggtttgacattcagggtacaacaaaaaggaagctgagaacggatattcattacccactcactaacttggacctcactccttatatttgctcaattttccggaaatatcctaaatacaacctctgtgcagtggtgaaccattttggtgatttggatggtggccactacactgctttctgcaagaattcagtcacccaggcctgatatagctttgataacacacgagtcagtgagattccagatacttctgttcaaaatgctatggatctcctgttctatagctgccagcccttttccataccaatacaaaagcgttaagagccaggaaaatggtgtttcctgaacactgcaaaacaagcagtcagcatctggtggtagagttttgcttggtcattaaactcttagaactta

SEQ ID NO: 197464 - DNA, 725 bp, Homo sapiens
  Payload ID: 18946
  Gene Name: ubiquitin specific peptidase 50
  ENST ID: ENST00000559105
  CDS Start-End: 142-327
agttcgcagctactggaagagagaggagcatatcaattgtttaaaacaaaaagccagcgttaacaggctcagagaaatgaagttgaaaggaatagatgtagctcctgaatagaagcaaaagtccaacgtggttccattaaaatgacttctcagccgtctctccctgcagatgacttcgatatctaccacgtccttaccactactcccggagaagatcatatgagaaaggatctactcagagatgctgcaggaagtggattaccactgagacatccatcatcacccagctgtttgaagagcagctcaattatagcatcgtatgtttaaagtgtgagaaatgcacctacaagaacgaagtcttcactgtcttctcactccccattccatccaaatatgaatgctcccttcgggactgtctccaatgtttttttcaacaagacgcactgacctggaacaacgaaattcactgctccttttgtgaaaccaagcaagaaactgctgtgagggccagtatttccaaagcaccaaaaataattattttccacctaaaaaggtttgacattcagggtacaacaaaaaggaagctgagaacggatattcattacccactcactaacttggacctcactccttatatttgctcaattttccggaaatatcctaaatacaacctctgtgcagtggtgaaccattttggtgatttggatggtggccactacactgct

SEQ ID NO: 197465 - DNA, 1419 bp, Homo sapiens
  Payload ID: 18946
  Gene Name: ubiquitin specific peptidase 50
  ENST ID: ENST00000616326
  CDS Start-End: 181-1212
aaatccaagttggagtggtgcctgatacaggtgaaaatcagttcgcagctactggaagagagaggagcatatcaattgtttaaaacaaaaagccagcgttaacaggctcagagaaatgaagttgaaaggaatagatgtagctcctgaatagaagcaaaagtccaacgtggttccattaaaatgacttctcagccgtctctccctgcagatgacttcgatatctaccacgtccttgcagagtgcacagattactatgatacccttccagttaaggaggctgatgggaaccagccccattttcagggtgtcactggcttgtggaacttgggcaacacatgctgcgtgaatgccatctcacagtgtctctgcagcatcttgccgctggtggaatactttctcaccgggaagtatatcaccgctctgcaaaataaaacatatccctttcttcttccaagcgattgcagtgaagttgccactgcttttgcctatctgatgacagacatgtggctgggagactcagactgtgtctcaccagaaatattctggtcagctcttggcaacctctacccagcatttacgaaaaagatgcaacaagatgctcaggaattcttgatttgtgtcctaaatgaacttcatgaagctctaaaaaagtaccactactcccggagaagatcatatgagaaaggatctactcagagatgctgcaggaagtggattaccactgagacatccatcatcacccagctgtttgaagagcagctcaattatagcatcgtatgtttaaagtgtgagaaatgcacctacaagaacgaagtcttcactgtcttctcactccccattccatccaaatatgaatgctcccttcgggactgtctccaatgtttttttcaacaagacgcactgacctggaacaacgaaattcactgctccttttgtgaaaccaagcaagaaactgctgtgagggccagtatttccaaagcaccaaaaataattattttccacctaaaaaggtttgacattcagggtacaacaaaaaggaagctgagaacggatattcattacccactcactaacttggacctcactccttatatttgctcaattttccggaaatatcctaaatacaacctctgtgcagtggtgaaccattttggtgatttggatggtggccactacactgctttctgcaagaattcagtcacccaggcctgatatagctttgataacacacgagtcagtgagattccagatacttctgttcaaaatgctatggatctcctgttctatagctgccagcccttttccataccaatacaaaagcgttaagagccaggaaaatggtgtttcctgaacactgcaaaacaagcagtcagcatctggtggtagagttttgcttggtcattaaactcttagaactta

SEQ ID NO: 197466 - DNA, 4407 bp, Homo sapiens
  Payload ID: 18947
  Gene Name: ubiquitin specific peptidase 51
  Uniprot ID: Q70EK9
  ENST ID: ENST00000500968
  CDS Start-End: 84-2219
gtcccctggcatgatctgatcgcctttgaagcagtcgcagctgttttccagacgccttgctcctcaggtcggggagtgatctgatggcccaggttcgagaaacttctttgccctccggctctggggtccgctggatctccggaggtgggggaggagcctctcctgaggaggcggttgagaaggcggggaaaatggaggaggcggcggcgggggctacgaaggcgtcttcgagacgtgaagccgaggagatgaagctggagccattacaagagcgtgagcccgcgccggaggagaacttgacgtggagcagcagcggcggcgacgagaaggtgctcccttcaatcccccttcgctgtcacagcagctcctcgcccgtttgcccgcgccgcaagccccgccctcggccccagccccgggcccgctcccgcagccagcctgggctctcggccccacccccgcctccagcccggcccccgcccccgccgccacccccgcccccacccgcaccgcggcccagggcctggcgtggatcccggcgcagatcccggcctgggtccaggcctcagacacggagaagctgctctggtgacctagacgggtcgggggatcctggcggcttaggggactggttgctggaggtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgccaaagaaacaaaagaaaaaattttgagattattaacttccacctcaacagatgtttctcatcaacagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaagatgatagtggtgggcaggaggccaataaccccaactgctgtaactgcatcatagaccaaatctttacaggtggcctgcaatcagatgtcacatgtcaagcctgccatagtgtttctaccaccatagacccatgctgggacatcagtttggacttgcctggctcttgtgccacattcgattcccagaacccagagagggctgacagcacagtgagcagggatgaccacataccaggaatcccctcacttacagactgtctacagtggtttacaaggccagagcacctaggaagcagtgccaaaatcaaatgcaatagttgccaaagctaccaggagtctactaaacagctcacaatgaaaaaattacccattgtggcttgttttcatctcaagcggtttgagcatgtaggcaaacagaggcgaaagattaatacctttatctcctttcccttggagctggacatgactccgtttttggcctctactaaagagagcagaatgaaagaaggccagccaccaacagattgtgtgcccaatgagaataagtattccttgtttgcagtgattaatcaccatggaactttggaaagtggccactataccagcttcatccggcaacaaaaggaccagtggttcagctgtgatgatgccatcatcaccaaggctaccattgaggacttactctacagtgaagggtatttactgttctatcacaaacagggtctagagaaagactagtcttaccagaccacttactgaaaaaaaagtaaatgattaggcaaggattttgaagtgacacacagacctacttggaatggacaatgacagtaacacctatgtgacagctagtatcttgatataaagaacctattttagcatggcccatgggtctgtcggaagaaaaaaatgaatactaaccagtgaccattcaaccttaagaaatggggagagggagaagaggttgaaaatggtcacataaagcataatgaaatgaaaagaatgctttaggtggggacaacgggagtagaagtgttctgatgctactctatgtcatttgtttttacagaaatatcttgtgaagtcagggagtattcctttatcagcaaaaacttcacaattggtgttccagctgtggctgaccagctaaatagtttgaaagaaaaataatattttaaaataaagtttaaagagctttaaaagaaaaacatttaaaaaggaaaaaatcatttttaagattttaaaagaaaaaaacttttaaatgttgaaaaaaatttaagttgttatttttaaaagaaatattttaaaagttaaaaataattttttaatttaaagaagtttcagaattttaaaaattaaaagcaaagaaaattaaattcttaaagtttaaaaatgtaaaataaattaaggaacaaggttaaaaatgaaagtttaccaaaaaaaggaagaaaatactgttaaaaattaaagttagaaacaaaggaacatcttaaaagtttcaaatgaaggaaaataatataaatagatatttcaaaattaaagcataaaatatacgtatttaaaaagtgttaacaaaattactactataatgattaagaaataaattttcaaaaatacagaatggaatgcaattcagattttagagaaaagttttaaaagaggcaagtttagaataattcaagacaaaaagacaaaatgtgtttaaagacaaaaattgaaaaaatacaggaagaaaatagagacttgtaaaataaaaagaaccttagataagttcaagagatttaaatgaaaactttaaatatttaaataaagatttaaaaatttaagcttttaaaaagaaaaacagttacataaaaattgaccagtgaaaaaatgtgaaagattcaagtagaaaaaattattaaaattaaaagtttaagaagttctatttttttatttaagcatattaaaatacagacgggtatgaaagaaataaatggaggagacaggaataacgacagcggtgtgtgagtatatatatatatatatatttttttttttgagctttatgttgatatatcaatatacgttggaaaaggaaatagacattttaatcattatcttaccatccaattgtgaaatggctgcaaggcctaaacactaactaacccaccttcccctcttgagattccatgccccatctcatatcctgaaggaagtcaaattacttcctaggcagaatcaattcatctgagaaaaatgaaaacattagggactttcccatttagaactgcattattcatacaaattcttagcttctgaaaaggggctcttgataatttggtggcttagagaagttagatcacagctgtgaagctctggctttggtatttgagccccatggcctgattgaggaagtggcagggacccatatctgaggccttcccaccttcctttttccctcttccccctccaaggagaaacaagacctttaatttccacagtagagcaatgggtttgtgcttgcagtccttctgctcattctttattccctctttatttcctttttttgtcactcatgcctagttccctgaaccccttacttacctggccttacctacatctctgagccccagcctgcagggctccttctttgactattcacctggtggcttttactcctccttcaagacccaactcacagatgacttctctggagtcttccctgaatgctctaggcaggtataaatgagaaaattgttcctctcttcccctctttattcctctcactgtgcctccaaagtactttgtccatacctcggtgatagtacttattctactgtgattttattgtagctttgtgattgtctgcccctctgcactgagcatctaagaacagggggccaagccttattcatttctgtgttaataaatatttgttaaatgtgaa

SEQ ID NO: 197467 - DNA, 5936 bp, Homo sapiens
  Payload ID: 18948
  Gene Name: ubiquitin specific peptidase 53
  Uniprot ID: Q70EK8
  ENST ID: ENST00000274030
  CDS Start-End: 1180-4401
ctgggtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagttccgtgatgatggtctaagcaaagacccttcgtcctgttaaagataaattaaaaaaaaaaaaaaaaaaccaaagggaacaaaacttactctgcaaaagtaatatatgatttacctgctgttgtcataagaattccaaatagacaaactcggtatgcttgggatttgctttacattctaagtggatttggagaagagacaataaagaataagcagtcaattctataatatatttagaaggagaaaagtgccaaggaggaatgaaaaagtagaacaagagacagcatcttgctgccacccaggctggagtgcagtggtgcagtcttagcttactgcagcctcaaacttctgggctcaagtaatcctcccgcctcagcttcctgagtagctgagattacagatttgctttgaggtcacattgatatgaaatatggagtcaccttttataacttcacctgggaaagagagagaaaactttcttgttaaaaaaacataaggaaaacaaacaaccaaaggaatcatgccaaatgccaactctacatctttttgtattattaacatattttatgcatcaagacaaatggcttatgcattaaaggggatgattcgttcatcagtatttttagccattaaaaaaaatcgttttcatattaaccttatacagctcccataaaatttaacacatataaacatctttaacgccttgtttaaaatagctttcttttttagtgcttagaacttcaatgtttatgcaccctattgttacttgtcagagtctttaagagtttataacatcaggaaagatatggacttggaaacttacattattaaaatagactgcagtggatttaattggacaattcaagacatccattttattgtccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgaaaatatgttggagaggattcattttcacatagtgccaagcagagatgcagacatgtgtacctctaaatcttgtatcactcaccagaagtttgctatgactctgtatgaacagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagtta

SEQ ID NO: 197468 - DNA, 6072 bp, Homo sapiens
  Payload ID: 18948
  Gene Name: ubiquitin specific peptidase 53
  Uniprot ID: Q70EK8
  ENST ID: ENST00000450251
  CDS Start-End: 545-3766
agatttgctttgaggtcacattgatatgaaatatggagtcaccttttataacttcacctgggaaagagagagaaaactttcttgttaaaaaaacataaggaaaacaaacaaccaaaggaatcatgccaaatgccaactctacatctttttgtattattaacatattttatgcatcaagacaaatggcttatgcattaaaggggatgattcgttcatcagtatttttagccattaaaaaaaatcgttttcatattaaccttatacagctcccataaaatttaacacatataaacatctttaacgccttgtttaaaatagctttcttttttagtgcttagaacttcaatgtttatgcaccctattgttacttgtcagagtctttaagagtttataacatcaggaaagatatggacttggaaacttacattattaaaatagactgcagtggatttaattggacaattcaagacatccattttattgtccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgaaaatatgttggagaggattcattttcacatagtgccaagcagagatgcagacatgtgtacctctaaatcttgtatcactcaccagaagtttgctatgactctgtatgaacagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttgactgattgcgtaaatcgtgttaaaacattctaaaatgttgtaactaatttaatgtgaatactgttaaacagaaaataattgcttataaaagtctaacttcacccagttaccaagtcttggccaaattttatcttctgcctatagtttttactagcctttttaaactataatagtgagtgatcattactttatattctcgtaagttagaaatacttgaatgccaaattaattttgttttaagaaagcttatttttaacataattttttagtgtggagggtttgtaaataatgtaaagtttgtaaacctgtatttaaaataccaaagtttttcttcttttataacattgtaagatactagaaaaatgggcttcaagttttttaatagctttcacagtttgtgtagttttttttttctatttggttaagatgtgagttggaaatgtattatttgaaacatttaaactaatttttgtatttaacagcagtctcagacatttgtcttttcaactcagttgagttgtagatatcaaatagaaatgtccagttttgcctcttttaagtactgtccagttgaaacctcctgactcatgtactactacacaaactagaaaatgcccatttatttttgttgattcaacactccagatacagattgatacatatatactaatcattttatttcatgtaaaagttttacatctagggtgcctatttatttttatagatgctttcatccagttataagcttattataactttgtaaatatttcagccaacagttgtaatgtttaaaatacttaccttcagaatgttatattttcatgtgaaatcaatttcttctaattcaaaaaaattttaagataaactgatttttaagttt

SEQ ID NO: 197469 - DNA, 546 bp, Homo sapiens
  Payload ID: 18948
  Gene Name: ubiquitin specific peptidase 53
  ENST ID: ENST00000507906
  CDS Start-End: 1-195
cattattgtgcctttgcatttcacaccaaaagttccaaatgggtattttttgatgatgcaaatgtgaaagagattggaactagatggaaagatgttgtctccaaatgcattcgatgccactttcagccactacttttgttttatgcaaacccagatggcacagcagtttctactgaggatgcactcaggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatgg

SEQ ID NO: 197470 - DNA, 4803 bp, Homo sapiens
  Payload ID: 18948
  Gene Name: ubiquitin specific peptidase 53
  ENST ID: ENST00000509769
  CDS Start-End: 121-1104
cattattaaaatagactgcagtggatttaattggacaattcaagacatccattttattgtccaaaatattacataaaagtgtacagtttttagcctaaatgcaaacaaagttgcttgaaaatggcatgggtaaaattcttacggaaacctggtggcaatcttggaaaagtttatcagcctggaagtatgctatcactagcccctaccaaaggcttgttaaatgaaccaggacaaaacagctgctttcttaatagcgctgtacaggttttatggcaattggatatattccgacgaagcttgcgggttttgactggacatgtttgtcagggagatgcctgtatattttgtgcattgaagacgatatttgcacagttccaacacagtcgagaaaaagcacttccctcagataacataaggcatgctcttgcagaaagtttcaaagatgagcagcgatttcaacttggccttatggatgatgctgcggagtgctttgaaaatatgttggagaggattcattttcacatagtgccaagcagagatgcagacatgtgtacctctaaatcttgtatcactcaccagaagtttgctatgactctgtatgaacagtgtgtgtgtcgtagctgtggagcatcgtcagatcctctaccttttacagaatttgtgcggtacatttctacaacagccttatgcaatgaggttgaaagaatgttggaaaggcatgaacgctttaaacctgaaatgtttgcagaattgctacaagcagcaaatacaacagatgactataggaaatgtcctagtaactgtggccaaaaaataaaaattcgccgtgttttaatgaattgcccagagattgttacaattggtttagtctgggactccgagcattctgacttgaccgaagctgttgttcggaatctagcaacacatctttatcttcctgggcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagagataataccttgaagtgggatttctgggttgtgtgattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggatgtgaaaagcctgtaattcataagtcagataatttaaaagaaaatggatttggtgatcaggcaaagcagagagaaaatcagaaatttccaactgataatatttcatcatctaatcggagccacagtcacacaggtgtagggaaaggaccagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagagatttggttgatgaagacctttcacatttccaatctggatcacctcctgccccaaatggttttaaacaacatgggaatccacatctatatcatagtcaaggaaaaggatcatataaacatgaccgagttgtacctcagagtcgagcttctgcacaaataataagttcaagtaaatcccagattcttgctccaggagagaaaataactggcaaagttaagagtgacaatggcactggatatgacacagacagcagccaagattctagggatagaggaaacagctgtgatagcagcagtaaaagccggaaccgaggttggaaacctatgagagaaacattaaatgttgatagtatttttagtgaaagtgaaaaaagacagcatagtccaagacataaaccaaatatcagtaataagcctaaatctagcaaggatccgagttttagtaattggccaaaagagaatccaaagcaaaaaggtttaatgaccatatatgaagatgaaatgaagcaggaaataggaagcagaagttcccttgaatctaatggaaaaggagcagagaaaaataaaggccttgtagagggtaaagtgcatggtgataattggcagatgcaaaggactgagtctggatatgaaagcagtgatcacatcagtaatggttctactaatttggactcacctgttatcgatggaaatggtacagtaatggatatcagtggtgttaaagaaacagtatgcttcagtgaccagattacgacaagcaacctaaataaagaacgtggggactgtacctcccttcagagccaacatcacttagaaggctttagaaaagaactcaggaatttggaagcaggctataaatctcatgaattccacccagaatcacatttacaaataaaaaatcatttgataaaaagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataaaaattaaatttgtccccctattttgtggccagtagactgggaagtattaaactaaccagtactcatgtatggagattataaactatgctaattgaaaagtaccaggtgatacatagcctggtacttttttgtcaaagaattgctttatgaagaagcactttctaatgggtaaccagaaaagggcttcacccatttgtttttgacttctatgatagtcactgcatatgatccctttaagtgtctttaaaaaaaatgacttatgaatttgatagcatttggggaaaaaaagccttatatgattaacaatttgtaagttttcaagatcggatggaatttaattttgctcctagaatttttgtcttcagaatatctagttaagataaattaggcctttgactattataggtattcataaatgctactttagccatgtaagttaaaaagttaaaatacttaaactttagtgtatttatttatctcgttactttttttctaattttatatgaaatgtgaaaggtctttattttggtttggtttactttgggctgctaaccaccagtgttaggaattaatgtagggcaccctcttattgggaatgtcactgtaattgcctacattttctttgctgtaatattacctgcttataggttgtcaacccattttatctgaatttgaaaatctatctaggtttccagattaaatttctacctttcatatagagagtttaattttaataaaatgtttaattagagcatccttcccttttattctactttgaacaaatagtaattttaccccaactacttttcatgaagagtgctttgaaaattaaaggaatttttattattatggtaaccttatgagtaaaaataagttactttaattgctttatttcgttagttgtcattttattttgtactatgctggtaaactaattgtggtttagaatagttttatgttcactcctgataactgagaaacagaactaaagttttccttacattgctaaatggataaacctcatattcaataaactagtaaatgtagccacttga

SEQ ID NO: 197471 - DNA, 6247 bp, Homo sapiens
  Payload ID: 18949
  Gene Name: ubiquitin specific peptidase 54
  Uniprot ID: Q70EL1
  ENST ID: ENST00000339859
  CDS Start-End: 102-5156
gtttacggagactcggaactggataaagggaccaggctacattgggaaagaagtgggaagaaatggggtacagcgacgaggagggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatcagaaatttgcaatgacattgtttgagcagtgtgtatgtactagctgtggtgccacttctgatccgctgcctttcatccagatggtacattatatctccaccacttccctttgcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagacttagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatctctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaa

SEQ ID NO: 197472 - DNA, 6161 bp, Homo sapiens
  Payload ID: 18949
  Gene Name: ubiquitin specific peptidase 54
  Uniprot ID: Q70EL1
  ENST ID: ENST00000408019
  CDS Start-End: 18-5072
gctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatcagaaatttgcaatgacattgtttgagcagtgtgtatgtactagctgtggtgccacttctgatccgctgcctttcatccagatggtacattatatctccaccacttccctttgcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagacttagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatctctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctattt

SEQ ID NO: 197473 - DNA, 5201 bp, Homo sapiens
  Payload ID: 18949
  Gene Name: ubiquitin specific peptidase 54
  ENST ID: ENST00000424265
  CDS Start-End: 1-1906
accttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagacttagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcagggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggacacctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatcttgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaa

SEQ ID NO: 197474 - DNA, 509 bp, Homo sapiens
  Payload ID: 18949
  Gene Name: ubiquitin specific peptidase 54
  ENST ID: ENST00000451492
  CDS Start-End: 79-509
cttgccccacagataccctcgtgattagaggtcttttgctggaggttgactgtgctgtctggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttctgtttttcagagtgacggatgaccgggccaagcaatctgaactgtacttagttgg

SEQ ID NO: 197475 - DNA, 4370 bp, Homo sapiens
  Payload ID: 18949
  Gene Name: ubiquitin specific peptidase 54
  ENST ID: ENST00000418501
  CDS Start-End: 1-1075
cctgactgatagtgaatgtaatcagaaacacacatccaagaaagggtcactgatagagcgcaagaggagctctggtcgggttaggaggaaaggcgatgagccccaggcctcgggataccacagtgaaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaa

SEQ ID NO: 197476 - DNA, 543 bp, Homo sapiens
  Payload ID: 18949
  Gene Name: ubiquitin specific peptidase 54
  ENST ID: ENST00000413442
  CDS Start-End: 83-543
atcacttgccccacagataccctcgtgattagaggtcttttgctggaggttgactgtgctgtctggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaagggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatca

SEQ ID NO: 197477 - DNA, 600 bp, Homo sapiens
  Payload ID: 18949
  Gene Name: ubiquitin specific peptidase 54
  ENST ID: ENST00000433394
  CDS Start-End: 361-600
atgcggcgccaggagctgctaagagatgggctctcctgtgttgcccaggctgtactcgaactcctaggctcaagtaattccttcccacctcagcctcctgattggctgggactacagctctctgacacagctggctattctagtcccagaagaaagaggagagacttgctgaagatctggatgggacaatagaagtttggggcacattaaaaagaagcagcaagaacatcaacaaaaacctcagatgattcaaacaggcttcttcttggctttgtggaaccttttgcagttgctcagaatttgagtttttgcttcagaggatgatgagacaaggcaatagagggctaaatgtgaacaataatgtcttggaagagaaattatttttcagggggtcgtggtagtgtacaagggatgtttgcacctcgaagctcaacctccatagcccccagcaaaggcctcagcaatgagccagggcaaaacagctgcttcctcaacagtgccctgcaggttttgtggcacttggatatcttccgacgtagctttaggcagcttacaactcacaagtgcatgggagattcctgcatcttttgcgctctcaag

SEQ ID NO: 197478 - DNA, 2777 bp, Homo sapiens
  Payload ID: 18949
  Gene Name: ubiquitin specific peptidase 54
  Uniprot ID: Q70EL1
  ENST ID: ENST00000422491
  CDS Start-End: 338-2515
ctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgg

SEQ ID NO: 197479 - DNA, 4674 bp, Homo sapiens
  Payload ID: 18949
  Gene Name: ubiquitin specific peptidase 54
  ENST ID: ENST00000466048
  CDS Start-End: 1-1238
ggagggagccctccatctcaagtgacactcgaacagattcctcaacggagagctatccctacaaacattcccaccatgagtctgtggtcagtcacttctcttctgattctcaggggacagtcatctataatgtggaaaatgattccatgtctcagagcagtcgggacacaggagaaacactgaaagagaagcaggctcctagaaatgcctccaaaccatccagcagcaccaacaggctgagagattttaaagagacagtcagcaatatgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtgaggagatatcttctaaaagtgaactggatgaattgcaggaagaggtggccaggagggcgcaggaacaggaacttcgaagaaaacgggagaaggagttagaggcagcgaaagggtttaaccctcatcctagccgcttcatggacttggatgaactgcagaatcaggggaggagtgacggctttgagaggtccctgcaagaggcagagtcagtgtttgaagagtcactacatctggaacagaaaggagactgtgctgcagctttggctctctgtaatgaagctatcttgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacagctcccccagtagatctgccttgaagcttctgacttcggttgaagtagacaacattgaaccctctgcattccacaggcaaggtttacctaaagcaccagggtggactgagaagaattctcatcatagttgggagccattggatgccccagagggtaagctgcaaggctctaggtgtgacaacagcagttgcagcaagctccctccacaagaaggaagaggcattgctcaagaacagctgttccaagaaaagaaggatcctgctaacccctccccggtgatgcctggaatagccacctctgagaggggtgatgaacacagcctaggctgtagtccttcaaattcatcagctcagcccagccttcccctgtatagaacctgccaccccataatgcctgttgcttcttcatttgtgcttcactgtcctgatcctgtgcagaaaactaaccaatgcctccaaggccaaagcctcaaaacttcattgactttaaaagtggacagaggcagtgaggagacctataggccagagtttcccagcacaaaggggcttgtccgttctctggctgagcagttccagaggatgcagggtgtctccatgagggatagtacaggtttcaaggatagaagtttgtcaggtagtctaaggaagaactcttccccttctgattctaagcctcctttctcacagggtcaagagaaaggccactggccatgggcaaagcaacaatcctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatggcaggggagcccaatagactcccaggaacttcaaggagtgtccagcagtttctggctatgtgtgacaggggtgaaacttcccaaggggccaagtacacaggaaggactttgaactaccagagcctcccccatcgctccagaacagacaactcctgggcaccctggtcagagaccaaccagcatattgggaccagattcctgactactccagggtgcaatcctcaactaacctacactgccacactaccagaaagaagcaagggccttcaggttcctcacactcagtcctggagtgatcttttccattcaccctcccaccctcccattgttcatcctgtgtacccaccatctagcagtcttcatgtacccctgaggtcagcttggaattcagatcctgttccagggtcccgaacccctggtcctcgaagagtagatatgcccccagatgatgactggaggcaaagcagttatgcctcccactctggacacaggagaacagtgggagaggggtttctgtttgttctatcagatgctcccagaagagagcagatcagggctagagtcctgcagcacagtcaatggtaaaggttattcctttcctttcctggagctacacctttctttgtaaaactgtactgtgggccgggcgcggtggctcacacctgtaatcccagcactttgggaggctgaggcgggtggatcacgaggtcaggagattgagaccatcctggccaacatggtgaaaccccgtctctaccaaaatacaaaaaattagccaggcgtgacggtgcgtgcctgtagtcccaactactcggaaggctgaggcaggagaattgcttgaacccgggaggcagaggttgcagtgagccgagatcgcaccactgcactccagcttggcaatagagtgagactccatctcaaaaaacaaaacaaaacaacaacaaaataaactactgtggcagcgttggtaccctgcatcactgccatggttgtgctattctcatctcaacatagaattggtgggttctcctaagggtgtcaggaacctctaaaaagatgtgattctttgggaggggatatttgaaattccaacttccattccccctagcaaaaggaagcagctgctgtttaagggttttatctgagccactttaaagatgaatccatggtattactctggatactagccattccttaggattttaaggtcacattttattcctggatgctttatgtccccacctccacctgagccctcatcctctgttccctactatactcccaacttctactctttgttttatccacctatccctattacctgaccctttgtcttccctgtctcccatccttggggggacatgtagccctgtggtcatggttctgatgacatcatcagggcagcccccctgcccaggtattatggcctgtcagcattccctgtgccctccaaaccttaggcctagaatgcggagctgccaacataacattcacccttttgaacagatggagtcaggcacactaacacagccttctgtcctcaataacacagccattattgccacttgctcagtcgtcaatgtaaaccctcagagtcagctgaactattttaggccaaacatactgtttttgtaaagtatttttcattaataaatctataagacagttctatttaa

SEQ ID NO: 197480 - DNA, 7976 bp, Homo sapiens
  Payload ID: 18950
  Gene Name: ubiquitin specific peptidase 6
  Uniprot ID: P35125
  ENST ID: ENST00000250066
  CDS Start-End: 1700-5920
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccaggcaaggccccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccgaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatcccaatggggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagaactttcctcaggataaccaaaaagtacaactctcagtgagcggatttttgtgtgcatttgaaattcctgtcccttcatctccaatttcagcttctagtccaacacaaatagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtcaaatt

SEQ ID NO: 197481 - DNA, 8464 bp, Homo sapiens
  Payload ID: 18950
  Gene Name: ubiquitin specific peptidase 6
  Uniprot ID: P35125
  ENST ID: ENST00000574788
  CDS Start-End: 2231-6451
gccgccgtctcgtgtggtgtctgaggggcgtctacctggagtcactgagccgacgaaagggaaaaggccagtgcctgtccgggaagagctcagcctagtggggcgggcgacaagttacagttgctgccttacgatggccgtggcccgtggaggcactagaccctcaccaggggtctgtcaggaaaggcgggcagatacgtgaggcctgaacaggaaggaactgggagacccaagactgtaccgccaagaccgctttcgagtcgggccgaccggaatttgaattcgtttcttcacttactagttgatttttttccttgattccttcgtgggactcaagacaggggtgccctgtttactcagcccactgtgctcaacctcttgcaggagtgtgcaggaaatgaaggccctttgaggtcaggtggatgaggatgtcagtgtgaagatggacactgtgcctggagtgaacctgagctggatcctgaatgagatgcatgaccaggacaagaaattggtggagaagagctacaaggatgccaagggctgtttcttcagcatgagagaggggctgaactgcgaggtggccaccaacacagaggccctgcagagcggcaggatagagatatggagctctacatctctgtgcagaacctgagccatcccagctcagcaaggtagggcctctgtcccctccccaccctgtacctatcaccccagggtgagcccagccttatagacccctgcttggaggtgtgttacgggacccaactggcccagctgcaggggctcatcagaagcatggagcagcagctgtgcgagctctgctgcgacgcggagcaccaggaccatgagcaccaggtccttctggacgtgaagacacggctggagcaggagatcgccacctacagccgcttgctagaggttgaggacgctcaagtcacagggagaagacgtccacccacacatcaggagacaggcctggaacagagccttcctgcacagcctcagaagggacccaccctggtgacaccttgatcttggactgacactcatgacctccagtactgtgagacagtaacattctgttgttgaaggtgcccagtctgtggtactgtaaaacagccctgggaaactaacgcagcctgttagcccacagatggtgaagggatggaatgctccacggagctccaggcttactatctacagcccccaaagtgtgctgcgggacccttgggtgggtgtaggtatgcaaggtaattttgggtggttcaaggtgaataatttcaattgacataataatgtatttatcttgctgggtaaatgagggatacccaactgttaggaaccaggcaacacagcaggaggtgagcagccagccagtgagcaaagcttcatctgtagaaacagccacttcccatccctcgcattaccgcatgagctctgcctcctgtcagatgagcggtgccgttagattctcacagaagcatgaaccctactgtgaactgcgcatgccagggatctagattgcgtgctccttatgagaacctaatgcctgatgatctgtgactgtctcatcactgccagatggaaccacgtagttgcaggaaaacaagttcagggctcccactgattctacattatggctggagtgcaatggcgcaatctcggctctctgcaacttccgcctcctgggttcaagcaattctcctgcctcagcctcccgagtagctgggactacaggcatgtgccaccatgcctggggctgtcattgggacagtctgagatggggagtcgggggagacaatggatgaatggatggatgaatggacagcagtccagggagatgtccctgtgtgtcctgaactgggcccttcctccagtgagaagccttcctgagctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccgaatgtacccattcgacaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagaactttcctcaggataaccaaaaagtacaactctcagtgagcggatttttgtgtgcatttgaaattcctgtcccttcatctccaatttcagcttctagtccaacacaaatagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctcta

SEQ ID NO: 197482 - DNA, 7862 bp, Homo sapiens
  Payload ID: 18950
  Gene Name: ubiquitin specific peptidase 6
  Uniprot ID: P35125
  ENST ID: ENST00000572949
  CDS Start-End: 1700-4060
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccaggcaaggccccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccgaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatcccaatggggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtcaaa

SEQ ID NO: 197483 - DNA, 8185 bp, Homo sapiens
  Payload ID: 18950
  Gene Name: ubiquitin specific peptidase 6
  ENST ID: ENST00000575709
  CDS Start-End: 1700-2830
ctaaaaataccattaagtaatagtattagcttttgtattctgagattcaacagcagcagtcacttccctccactcctatgtgtatcccaggaccaccctgggcggggagggctgaggtcagggaggtctgaagctggtcctgggctccgggggtgacagtgatgaggaactgggtgcacacatgagtggggcagccgggcctggccagagaagcaacacacacgtgcacagacatgtttatccacatacacatgtgcacgcatgtgcacaaacacattgcaggcaggcatgttgacgcctcaggcagcggaggaccctgactctgggccctgctgacccaggcaaggccccattgtgatgcgtgccatgacctcagaatgtcactggtgcttagcacctatccgctctccagactgcgtctgtgttctacggcagttacacacacgcagtggtattcacaagcggttttgtggactcaaaggttttctccctgagaggcataacccaggccagctgattcatcagaatcaggtgagtgtgacctgctctcttccctccaggctgacttggggacagtggctatggtatgggcggtgttggcctctgggcagctacagaggagggtcatccctgagcactcaccgggcgcccgttctacactgcccatgtagacgattttctctttcgtcttcatggtggcttcgtagagtgggtgctgttcccgaatgtacccattcgacaggtgagccgtctggggtcagagaggcagtaactggcctgggaatccagacaagaccctgggttttgctctcagccctgctgtgtgccatgctagacttcaggcctcaaccctgagacctccctgctctagatcccaaatctgcccagatttccgatcccaatggggcagagcctggccctggcagagacactgggatggatccactgtgggtggggaggagggaagggtcctcagaacacacctggggcctaagctgggtcttgatggtcactgtgggacccactggacacacacagtcccttgtctgggagtggcatggggagccttctgcccttgggcagttgtggaaagtgaaggagccctggagagctggctgaggggagactatcttcccttgtgttcaaaggggtccaggcactggggctctccccaagtatttcttattctgtctggcctcgctttccttttgccctgagtattctcaggagggacggtccatctagatgtcctccaggagcaaggacccactgttcttcatcagtgacccaggaaaatgaagccccctcctgtggggacagctcagaatggtggagtccacagtccctccctgagagacatggtttccatgagcacagtggctgctttggagacagtaatcattttcatccccaaaaccaaacacactcctgctcaaatggtgttattgctaaagcagcttcactggttagactgaagggccatggtagcccaagtgatgagcggggtagaatggagcagtcaggagagatcttgttccccgtaggaaactgggcatctctgtggccctgaacatcccaggaggccgatcgtacagagacctctggtgcctgaccgcagttcacatccacatccctggaatagaccatcacaggctcttcacccttggcaggtggacaccattcaacctgccggggcaggatggacatggtagagaatgcagatagtttgcaggcacaggagcggaaggacatacttatgaagtatgacaagggacaccgagctgggctgccagaggacaaggggcctgagcccgttggaatcaacagcagcattgatcgttttggcattttgcatgagacggagctgcctcctgtgactgcacgggaggcgaagaaaattcggcgggagatgacacgaacgagcaagtggatggaaatgctgggagaatgggagacatataagcacagtagcaaactcatagatcgagtgtacaagggaattcccatgaacatccggggcccggtgtggtcagtcctcctgaacattcaggaaatcaagttgaaaaaccccggaagataccagatcatgaaggagaggggcaagaggtcatctgaacacatccaccacatcgacctggacgtgaggacgactctccggaaccatgtcttctttagggatcgatatggagccaagcagagggaactattctacatcctcctggcctattcggagtataacccggaggtgggctactgcagggacctgagccacatcaccgccttgttcctcctttatctgcctgaggaggacgcattctgggcactggtgcagctgctggccagtgagaggcactccctgccaggattccacagcccaaatggtgggacagtccaggggctccaagaccaacaggagcatgtggtacccaagtcacaacccaagaccatgtggcatcaggacaaggaaggtctatgcgggcagtgtgcctcgttaggctgccttctccggaacctgattgacgggatctctctcgggctcaccctgcgcctgtgggacgtgtatttggtggaaggagaacaggtgttgatgccaataaccagcattgctcttaaggttcagcagaagcgcctcatgaagacatccaggtgtggcctgtgggcacgtctgcggaaccaattcttcgatacctgggccatgaacgatgacaccgtgctcaagcatcttagggcctctacgaagaaactaacaaggaagcaaggggacctgccacccccaggcccaacagccctgggacgaaggtgtgtggcaggaagcccccagccagtctgaaccctgggggcagtcccaggagccacccaccatgccccaacggcttccccatgccaggcagcacacacccctccctctgggatcagcagactacaggcgtgtcgtcagtgtcagaccacaggggccacacagagaccccaaggactccagagatgcagccaaacgcgagcaagggtccttggcacccaggcctgtgccggcttcacgtggtgggaagaccctctgcaaggggtataggcaggcccctccaggcccaccagcccagttccagcggcccatttgctcagcttccccgccatgggcatctcgtttttccacgccctgtcctggtggggctgtccgggaagacacgtaccctgtgggcactcagggtgtgcccagcctggccctggctcagggaggacctcagggttcctggagattcctggagtggaagtcaatgccccggctcccaacggacctggatatagggggcccttggttcccccattatgattttgaatggagctgctgggtccgtgccatatcccaggaggaccagctggccacctgctggcaggctgaacactgcggagaggttcacaacaaagatatgagttggcctgaggagatgtcttttacagcaaatagtagtaaaatagatagacaaaaggttcccacagaaaagggagccacaggtctaagcaacctgggaaacacatgcttcatgaactcaagcatccagtgcgttagtaacacacagccactgacacagtattttatctcagggagacatctttatgaactcaacaggacaaatcccattggtatgaaggggcatatggctaaatgctatggtgatttagtgcaggaactctggagtggaactcagaagagtgttgccccattaaagcttcggcggaccatagcaaaatatgctcccaagtttgatgggtttcagcaacaagactcccaagaacttctggcttttctcttggatggtcttcatgaagatctcaaccgagtccatgaaaagccatatgtggaactgaaggacagtgatggccgaccagactgggaagtagctgcagaggcctgggacaaccatctaagaagaaatagatcaattattgtggatttgttccatgggcagctaagatctcaagtcaaatgcaagacatgtgggcatataagtgtccgatttgaccctttcaattttttgtctttgccactaccaatggacagttacatggacttagaaataacagtgattaagttagatggtactacccctgtacggtatggactaagactgaatatggatgaaaagtacacaggtttaaaaaaacagctgagggatctctgtggacttaattcagaacaaatcctactagcagaagtacatgattccaacataaagaactttcctcaggataaccaaaaagtacaactctcagtgagcggatttttgtgtgcatttgaaattcctgtcccttcatctccaatttcagcttctagtccaacacaaatagatttctcctcttcaccatctacaaatggaatgttcaccctaactaccaatggggacctacccaaaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcacctcaggagaatcgccccagcctctttggaatgccattgattgttccatgcactgtgcatacccggaagaaagacctatatgatgcggtttggattcaagtatcctggttagcaagaccactcccacctcaggaagctagtattcatgcccaggatcgtgataactgtatgggctatcaatatccattcactctacgagttgtgcagaaagatgggaactcctgtgcttggtgcccacagtatagattttgcagaggctgtaaaattgattgtggggaagacagagctttcattggaaatgcctatattgctgtggattggcaccccacagcccttcaccttcgctatcaaacatcccaggaaagggttgtagataagcatgagagtgtggagcagagtcggcgagcgcaagccgagcccatcaacctggacagctgtctccgtgctttcaccagtgaggaagagctaggggaaagtgagatgtactactgttccaagtgtaagacccactgcttagcaacaaagaagctggatctctggaggcttccacccttcctgattattcaccttaagcgatttcaatttgtaaatgatcagtggataaaatcacagaaaattgtcagatttcttcgggaaagttttgatccgagtgcttttttggtaccacgagacccggccctctgccagcataaaccactcacaccccagggggatgagctctccaagcccaggattctggcaagagaggtgaagaaagtggatgcgcagagttcggctggaaaagaggacatgctcctaagcaaaagcccatcctcactcagcgctaacatcagcagcagcccaaaaggttctccttcttcatcaagaaaaagtggaaccagctgtccctccagcaaaaacagcagccctaatagcagcccacggactttggggaggagcaaagggaggctccggctgccccagattggcagcaaaaataagccgtcaagtagtaagaagaacttggatgccagcaaagagaatggggctgggcagatctgtgagctggctgacgccttgagccgagggcatatgcgggggggcagccaaccagagctggtcactcctcaggaccatgaggtagctttggccaatggattcctttatgagcatgaagcatgtggcaatggctgtggcgatggctacagcaatggtcagcttggaaaccacagtgaagaagacagcactgatgaccaaagagaagacactcatattaagcctatttataatctatatgcaatttcatgccattcaggaattctgagtgggggccattacatcacttatgccaaaaacccaaactgcaagtggtactgttataatgacagcagctgtgaggaacttcaccctgatgaaattgacaccgactctgcctacattcttttctatgagcagcaggggatagactacgcacaatttctgccaaagattgatggcaaaaagatggcagacacaagcagtacggatgaagactctgagtctgattacgaaaagtactctatgttacagtaaagctaccactctggctgctagacagcttggtggcgagggagatgactccttgtagctgatacttggcaaaagtgtcactgaaagacaagctaaatgtagttattttatcctgttagaacaaaaattctaattaaaatagttaacttgaagagtagaaacaattgtattttgaagtctcatacaagctgtctgatagagaactttcaggcagatcccaccattagcctgtaaacaaaaggtgtggcaccagccacctgggaccaaataagaattgaattgtgcttgtccagatatgaacaaatatgtagtgagtatagagtttaccaataatcataacaaatattaaagatttccttggagtcagaggaaaaaacaaacaattataatgttgtctagggacgacatgatacgctacctcctttttcctgaagttttattccattatattgacaagatggagaaagcaagatcatgaaggtgtgcaaatgattcttacggcatggacaaggatttttcaatttattttttaaactgtttccataccctttctttttcttgctttttgtttttgccattgtgtttacgtttgagacacaaccagtcattggtggcaggggcatagagtggtcagtctgaaagggaggctctcttaagagctatgtgccttccaaccagagggagacccagtagaaagaaaaacatcctgggaaatccagctaccagggccctcccagtggaggcatcttacatttaggctacttcaagtatcctcagaaatgtattctgcacccccggccccgcccatgctgagggaaggggagcagttgccaatatttgcaccatcttcacatgcacatgttgcaacaagagcttctgggaaggtaagcggcatcggagctagatcacgtttcacaattagtggttattcttttctgtgtttgttttgcactttaaaaaagagagaacacatgcaaatgaacttgcttgtgtgtatttgatggctctaagggctataaattacaaacaaaacacatcccagacattaggagttcataagtatatttaatgaaattggtggttttaggaagtcaactttagttttgctttgtttgcatgtccactggtttttttattttgatatttgtctttttttaaattttacagtagtcattgaaagttatgtttctttgcttacttcattttttccctctaattatttaagattggaacaaaagtataaatattatttatttgaggtagaatttttttcatgtagtttcttaatatatacttgaaggaaatgtttcaccttatttttggtctttgtttattcatttagaccctgcaagttgattctcattgccagattccattaccctttcttcctcataggtagtaattaccaatgtaactaagcatttgtgttctgatatctgaggccagtaactattaatatctagttctcagagcatttggaaaggttatcttaaatggctacctaaattgaaatccttttcagaaaaaatataattgcaagtaggtaggagtggcctaaattgtctaatgtaataaagtcagacaaaatgcacactttatagtttcaagattttcagtaaataaaatctgtccattcctacctggacatgtcccattaaaaagtggaagattttaaataatttctttacagatgttttatttaaacaggtagcacaatctactaatgttgtgtgatttgtgttatactggttgtaattaatttttttaattcatgaactagcggaaaatttattaaattaactattaactacattcaccttgtaaattactgtataaaacttgttgacaatgcactgactttagaaagatgttaatgtacataaatagagtgtaaataaaatagtgttgatgtactgaaatatgaactgtatcaaaagtattggtaattgtatatggggtgtacctgtttatctgttaactattatccaaacaaattaaatactgtggttgcctctatgtgctgtttttcctcatacaagtaaacacagaaagtcaaa

SEQ ID NO: 197484 - DNA, 5412 bp, Homo sapiens
  Payload ID: 18951
  Gene Name: ubiquitin specific peptidase 7 (herpes virus-associated)
  Uniprot ID: Q93009
  ENST ID: ENST00000344836
  CDS Start-End: 200-3508
gtacgtgcgcgtctccctgccgccgccgccgcccgccgcgggccgccccggggccgccgtcgccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaagaa

SEQ ID NO: 197485 - DNA, 3587 bp, Homo sapiens
  Payload ID: 18951
  Gene Name: ubiquitin specific peptidase 7 (herpes virus-associated)
  Uniprot ID: Q93009
  ENST ID: ENST00000381886
  CDS Start-End: 117-3377
aaaaaataaaaaagaatgctgaggtagagctcctagagattctatgcagtcactctgatgtgggtgagagaacctcccccatcccccagcagaggccactgcagagccatgcagagatggctgggaaccacaggcttgggctggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttg

SEQ ID NO: 197486 - DNA, 1966 bp, Homo sapiens
  Payload ID: 18951
  Gene Name: ubiquitin specific peptidase 7 (herpes virus-associated)
  ENST ID: ENST00000542333
  CDS Start-End: 196-1725
aagaacaagattgcactctgagagaaggaaggcatggtgaagaggtggtgttgtggtgggccttaaagtaggcttaggacttgagctcggggatttggagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgacagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctg

SEQ ID NO: 197487 - DNA, 4533 bp, Homo sapiens
  Payload ID: 18951
  Gene Name: ubiquitin specific peptidase 7 (herpes virus-associated)
  ENST ID: ENST00000563961
  CDS Start-End: 138-413
ccgacgacgcgcgggaggaggaggaggaggccgccccgccgccgccgccgccgccgccgccccggctcgccgccgcccgcccgccgggctcgcagccccggcccccggccgcaggcgaggcccaggccgcggccgacatgaaccaccagcagcagcagcagcagcagaaagcgggcgagcagcagttgagcgagcccgaggacatggagatggaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataa

SEQ ID NO: 197488 - DNA, 3194 bp, Homo sapiens
  Payload ID: 18951
  Gene Name: ubiquitin specific peptidase 7 (herpes virus-associated)
  ENST ID: ENST00000563085
  CDS Start-End: 467-3194
atgttatctgccaggagctttaacttcatgaatgtttgaaacctgggagcgagcgctgtggcccattctcaagcgggagatacagatgacccaccaagaattactcagaaccctgtgatcaatgggaatgtggccctgagtgatggacacaacaccgcggaggaggacatggaggatggggagtaacggggcagttgaaagaaaccatcagtcacgggctgcaccaccagaaggactgctgttcagacctcctgccaaaagttcagcctccatgagaaactgcagccgtagttgagagttctctcacagtgcggtttacccctggcagctggctgaggcaatatctgaggaagacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgc

SEQ ID NO: 197489 - DNA, 577 bp, Homo sapiens
  Payload ID: 18951
  Gene Name: ubiquitin specific peptidase 7 (herpes virus-associated)
  ENST ID: ENST00000566273
  CDS Start-End: 101-577
gaatccacctgtttttcggggagtttgtacttggcagtgtgtggtgcagccagcatccggccaggtgtgcgcttgcaaccgtgcgaaagccctgccgcacatggctgcctgcatcagaatcaaacctgactcgaaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctgg

SEQ ID NO: 197490 - DNA, 559 bp, Homo sapiens
  Payload ID: 18951
  Gene Name: ubiquitin specific peptidase 7 (herpes virus-associated)
  ENST ID: ENST00000566004
  CDS Start-End: 169-559
atgttatctgccaggagctttaacttcatgaatgtttgaaacctgggagcgagcgctgtggcccattctcaagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaag

SEQ ID NO: 197491 - DNA, 3554 bp, Homo sapiens
  Payload ID: 18951
  Gene Name: ubiquitin specific peptidase 7 (herpes virus-associated)
  ENST ID: ENST00000565455
  CDS Start-End: 61-204
gatgtgggtgagagaacctcccccatcccccagcagaggccactgcagagccatgcagagatggctgggaaccacaggcttgggctggaagcgggagatacagatgacccaccaagaattactcagaaccctgtgatcaatgggaatgtggccctgagtgatggacacaacaccgcggaggaggacatggaggatggggagtaacggggcagttgaaagaaaccatcagtcacgggctgcaccaccagaaggactgctgttcagacctcctgccaaaagttcagcctccatgagaaactgcagccgtagttgagagttctctcacagtgcggtttacccctggcagctggctgaggcaatatctgaggaagacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagtgaccgatcctgagaaaggatttatagatgatgacaaagttacctttgaagtctttgtacaggcggatgctccccatggagttgcgtgggattcaaagaagcacacaggctacgtcggcttaaagaatcagggagcgacttgttacatgaacagcctgctacagacgttatttttcacgaatcagctacgaaaggctgtgtacatgatgccaaccgagggggatgattcgtctaaaagcgtccctttagcattacaaagagtgttctatgaattacagcatagtgataaacctgtaggaacaaaaaagttaacaaagtcatttgggtgggaaactttagatagcttcatgcaacatgatgttcaggagctttgtcgagtgttgctcgataatgtggaaaataagatgaaaggcacctgtgtagagggcaccatacccaaattattccgcggcaaaatggtgtcctatatccagtgtaaagaagtagactatcggtctgatagaagagaagattattatgatatccagctaagtatcaaaggaaagaaaaatatatttgaatcatttgtggattatgtggcagtagaacagctcgatggggacaataaatacgacgctggggaacatggcttacaggaagcagagaaaggtgtgaaattcctaacattgccaccagtgttacatctacaactgatgagatttatgtatgaccctcagacggaccaaaatatcaagatcaatgataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaatggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgaagttttacaggcggtcaccgaccatgatattcctcagcagttggtggagcgattacaagaagagaaaaggatcgaggctcagaagcggaaggagcggcaggaagcccatctctatatgcaagtgcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatgggatttccacaagatcaaattcgattgtggcccatgcaagcaaggagtaatggaacaaaacgaccagcaatgttagataatgaagccgacggcaataaaacaatgattgagctcagtgataatgaaaacccttggacaatattcctggaaacagttgatcccgagctggctgctagtggagcgaccttacccaagtttgataaagatcatgatgtaatgttatttttgaagatgtatgatcccaaaacgcggagcttgaattactgtgggcatatctacacaccaatatcctgtaaaatacgtgacttgctcccagttatgtgtgacagagcaggatttattcaagatactagccttatcctctatgaggaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggtactttaagagatcttctacagttcttcaagcctagacaacctaagaaactttactatcagcagcttaagatgaaaatcacagactttgagaacaggcgaagttttaaatgtatatggttaaacagccaatttagggaagaggaaataacactatatccagacaagcatgggtgtgtccgggacctgttagaagaatgtaaaaaggccgtggagcttggggagaaagcatcagggaaacttaggctgctagaaattgtaagctacaaaatcattggtgttcatcaagaagatgaactattagaatgtttatctcctgcaacgagccggacgtttcgaatagaggaaatccctttggaccaggtggacatagacaaagagaatgagatgcttgtcacagtggcgcatttccacaaagaggtcttcggaacgttcggaatcccgtttttgctgaggatacaccagggcgagcattttcgagaagtgatgaagcgaatccagagcctgctggacatccaggagaaggagtttgagaagtttaaatttgcaattgtaatgatgggccgacaccagtacataaatgaagacgagtatgaagtaaatttgaaagactttgagccacagcccggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagccta

SEQ ID NO: 197492 - DNA, 569 bp, Homo sapiens
  Payload ID: 18951
  Gene Name: ubiquitin specific peptidase 7 (herpes virus-associated)
  ENST ID: ENST00000569230
  CDS Start-End: 217-569
agctgcgccccgcctggggttgctcttgaggagccaaactttgccagattaggctgacagtgagaaaataaattcttccacggtagatactgggtgaaaaagtgcacgtcagcgggcaaggcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggattttccaattttatggcctggagtgaagt

SEQ ID NO: 197493 - DNA, 479 bp, Homo sapiens
  Payload ID: 18951
  Gene Name: ubiquitin specific peptidase 7 (herpes virus-associated)
  ENST ID: ENST00000564117
  CDS Start-End: 152-479
aatggaattcacggggaggaaagctgggtataggcattaagtgcccagtagagcagcgggagatacagatgacccaccaagaattactcagaaccctgtgatcaatgggaatgtggccctgagtgatggacacaacaccgcggaggaggacatggaggatgacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtcatggtcttgccatgcacaagcagtgctgaagataataaattacagagatgatgaaaagtcgttcagtcgtcgtattagtcatttgttcttccataaagaaaatgattggggatttt

SEQ ID NO: 197494 - DNA, 313 bp, Homo sapiens
  Payload ID: 18951
  Gene Name: ubiquitin specific peptidase 7 (herpes virus-associated)
  ENST ID: ENST00000567692
  CDS Start-End: 1-52
gaattactgtgggcatatctacacaccaatatcctgtaaaatacgaagttaaaccgaatttaacagagagaattcaggactatgacgtgtctcttgataaagcccttgatgaactaatggatggtgacatcatagtatttcagaaggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagt

SEQ ID NO: 197495 - DNA, 332 bp, Homo sapiens
  Payload ID: 18951
  Gene Name: ubiquitin specific peptidase 7 (herpes virus-associated)
  ENST ID: ENST00000563043
  CDS Start-End: 1-207
gatcccaaaacgcggagcttgaattactgtgggcatatctacacaccaatatcctgtaaaatacggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggttgcaaagacagttgcacagaggctcaacacagatccaatgttgctgcagtttttcaagtctcaaggttatagggatggcccaggtaatcctcttagacataattatgaaggt

SEQ ID NO: 197496 - DNA, 4243 bp, Homo sapiens
  Payload ID: 18952
  Gene Name: ubiquitin specific peptidase 8
  Uniprot ID: P40818
  ENST ID: ENST00000307179
  CDS Start-End: 199-3555
aatgcaaatcgggaaaagggggtgagctgggctggcttccgtcctggtagccaaggctaattctccctcgagttcttgggagatgggcatttggcgagaaggctggcgttagtgaagcgcgcccggcgtcacggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataa

SEQ ID NO: 197497 - DNA, 19026 bp, Homo sapiens
  Payload ID: 18952
  Gene Name: ubiquitin specific peptidase 8
  Uniprot ID: P40818
  ENST ID: ENST00000396444
  CDS Start-End: 339-3695
aatgcaaatcgggaaaagggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatatattcaaatcatattcttaaactcatcgagccatttgaacaaaaattatttttgtttagcttcatgagtatctttggaaaataatttgttgaatatatatgattatgagatattttctgataaacactgaattttgaaacctgaactcactatataattgcagtgttttgaaggcctgcatccattagcattgcattatattcacactgccttttttagtgaaccaagacccatcttctggacgacagatttatcttaagatgaaaggttgtataacatgcccacaaggcataaaaatgttaatgatgcaagtaagttctaagagtttaatgaccaagcaaaactctaccaccagatgctgactgcttgttttgcagtgttcaggaaacaccattttcctggctcttaacgcttttgtattggtatggaaaagggctggcagctatagaacaggagatccatagcattttgaacagaagtatctggaatctcactgactcgtgtgttatcaaagctatatcaggcctgggtgactgaattcttgcagaaagcagtgtagtggccaccatccaaatcaccaaaatggttctatgggagaaaggaatgtcaaacttagtattcacatatgaacactaactactggaacagaaatgatagggccaagagatgctttttaaattgtcccttattctaaattaaaaggaagtgataattttgttgttaaatcatgcatatagcctgactgctatattgcttctcatttcattgtaactacttatatgttgtgcccattgactatcatctgtgaataaagaaagacaatatttagcagcatctgattaatgtttatcagtgaacatttagttagcacttaatatacatcaactattaagcattaaaggaaattttacaataagaagataattcaggccgggcacagtggctcacacctgtaatcccaacactctgggaggctgaggcaggtggattgcttgagtccaggagttcaagaccagcctgggcaaaatagcgagactccatatcttttaaaggaaaaaaaaaaaaaaaaaaaagatgagctaggcatagtggtgcacacctgtagtcccagctacttgggaagttggggtgggaggatctctcgagcctgagaggtcgaggctgcaatgagccgtgattgtaccactgcactccagcctgggtgacagagtgagaccctgtcttaaaattgtaagttcatttacgtaagatggcttcttttttttttttttaaagttaggataagccacagaagagacatttaacattagaataaggatcttaactgcatattgctacagcacaaattgagggggctatgtagcaacaacccctcaatcccccatagggtacaaaaaataatgtatctcattttcctttttccatgtctttcctaacccagtattgtttggaacaaaggcattagagaggtgtacttccaaggaggtgttatggtgtatgataagggtcagcaaaccacggcccgtgggtcaactccaggctgtttttgtaagacccatgcattagcaacgggttttaaatttttatatggttggggaaaagatccaagtaataatagtattgttatatgtgaaaattttatgaaattcaaatgtcaatgtccttaaagttttatgggaacacagtcatgctcatttgtttacacttttcagtggctgctttaatgatacaacagtaaaactgaatagttgcagccaataccatatggcttatgaggcctaaaatatttactgtttggcctttaacagaataagtttgctgacctctgctgtagaggaagaaaattgattatttgttaacttatttttaattttttgagatggagtctctctctgttgcccaggctggaatgcagtggcacgatctcggctcactgcaacctccgcctcccaggttcaagcaattcttctgcctcagccttccaagtagctgggagactacaggtgcctgccaccatgcccagctaattttttgtatttttagtagagatggggtttcactgtgttagccaggatggtctcgatctcgacctcgggatcctcccacttcggcctcccaaagttatttatttttatttgagacagagtcttgctctgttgcccaggctggagtgcagtgacgtgatctcagctcaccacaacctctgcttcctgggttaaagctcttctcctgcctcagcctcccaagtaactgggattacaggcacgcaccaccacacccagctaattttttgtatttttagtagagatggggtttcgccgtgttggccaggctggtcttgaactcctgacctcaagtgatccacctgcctccacctcccaaagtgctgggattacaggcgtgagccactgcacccagcctatttatttttagaagcagtttcttgctatgttgcccaggctgtacatgaattcctaggcacaagcagtcctctcacttcaggcccccaaatagctgggactacaggcatacaccaccatgtccagaatgaaaatggatctgactagttaattccaacgtgaattcgggtgtaatagtacattgtgaccttagcgaaattatttgacctttctgagctttaatttctcatctattaacatggcttgttttgtatagctgttatcaaatatctcatgtattgagggctagtacacaggagttatttattcaatattcccttcaaccttcgtcttccccacctctctccttacaggtaatagaaatatctgaaattcacatttaaaagatcaaggttccgccaggcctggtggctcacgcctgtaatcccagcactttgggaggctgaggcaggcggatcacttgaggtcaggagtttgagactagcctggccaacatggtgaaaatccatctcttctaaaaatataaaaattagctgggcatggtggcgcatgccggtaatcccagctacttgggaggctgaggcagaatcatttgaacctgggagatggaggttgcagtgagctgagatcatgccattgcattccagcctgggcggagccctaaacaggaaatttaacaacagtatggtgtgtggtttatgctttgtgactgcctgggcgtaaagacagtccctagtttctgtaaccagtatgctcgggttttaaaggtcacgcaaggacactcgaggtaaagtcttaggcccccctacaaggtgagaagttggattgagatccacatacaaagccaggacctttaaagacattcaccctcaatggaaggattaaaaaacaaaatccaccctctagtgcttgtgttagcttggactcatggtacagagaataaaagtcattcctgggaatttgtcaccatagacctaccttttcaccagtttgggattcaaatttatactacctgtgtggtctgcgaatcctgtgaacttaatatgaaaagtatttctagggcagttgccagaaggaaacagaatttctagattgttgcatgttaactcagacctaacaggatatccacatatgaaaccccaatgaagttgagatcacaattcaaaataatagaacatgcaaggaaacaatttatcataagagtcagaaggcaataagatttaaacccccaaggactttagataatagaattattaagcagaggctacaaataaagtatatttaaatatatttagaagaaggaaacaaactttagaaactaaatagaattttcagaaatgagaaatacaacatagttggccgtccatatttacgggctctgcatcttcagaatcaactaatgtgatgggaaagatttgaaaaaataatacaacaataaaaatatacatattttaaaatacagtgtaacaactatttacatagtatttatattgtattagatattataagtaatccagagatgacttaaagtatatgggaggatgtgcataggttacatgcaaatactactccaggcctggcatggtggctcacacgtgtaatcccaacgtttttgggggatggaggtgggcagactgcttgagcccaggagttgtagaccagcctgggcaacatggcaaaaccctgtctacacaaaatacaaaaattgaccaggcatagtggcacgtgcctatagtcccagctacttggtaggttgaggtgggagaatcacctgagcccaggaggtcgaggctacagtgagctgtgactgagccactgctctccagcctggcaacagaatgagaccttgtctcaaaaaacaaaaacaaaaaacaccagaaaagacaccattttatatagggcccttgagcatctgtggattttgatagtcaaagggatcctggaaccaactccctgcagatactgaggtacaactgtactggaaattaacttaatgaagatattaggacacagaaaatgaataaaccggactgggcgcggtggctcatgcctgtaatcctagcactttgggaggctgaggcgggtggaccatgaggtcaggagttcaagaccaacctggtacacatggtgaaaccctgtctctattaaaaaaaacaaaaaaaattagctgggcctggtggcgtgcacctgtaatcccagctacttgagaggctgaagcaggagaatcgcttgaacccgggaggtggaggttgcagtgagccaagatcgtgccattgcactccagtgtgggtgacagagtgagactccatctcaaaaaaaaaaaaaaaagaataaactataaaatgaagttggggaaattagcaagaatggagtagtgatggagaatacgtgttaagaggcatgaaaaattgaatgagaatattcagcgtatgtcctgtagaagttctaggaggagagaatcgagtaggggagcaaggcaatattaaaagtgataatggctgaaaatgattaatgagacatgaatcttcacatttaggaaatgcagcgagccagggataaataaaaataatactgcagaacaacagagacaaagagaaaaagcttaaaagcaaccagaaagaaaaagagagtttacccacaagaatctaacctgctggtagaagttctccatagcagccatagaaatcagagacaatacagtagcttcaaaataatagagaaaaataactgtcaatctggaatttgatttctagttatcatccaagaatgaaagtgaattaaagacttctcaaagactgagagacttcaggataacagaccctcactgaaaagcctactgaaatatatgccacatgaattttaaaaactcaatgaaggaagaagtgatacataatagacagtgattaacaaaaaagactgatgaagatccgggcaaatataacccaatatgaacagtagaaaaccatgataatgtctcctttggaggcatattaaaaaattaaaaaccggctgggcatggtggttcacacctgtaatcccagcactttggaaggccaaggcaggaggatcgtttgagcccaggagtttgagaccagcctgggcaacatagtgagacctggtctctaaaaaaaataaaaaagttggccatgcacagtagcatgcctgtagtcccagctacttggcaggcagaggcaggaggatcccttaagcccagagttcaaaactgtagtgagctatgattcattgcactagtgcactccagtctgggcaacagagtgagaccctgtctcaaaaacaaaagatgctgaaaacagtagttcagtgatcagaattacagtgttctaagagctttccatttctttgggagcagagtataaagatcttgattaactttaggctttaagtatgaaagctgtcgttttttagcataattactaaagaatcaaaatgtgtaacttccaaagttgtagagggaaaataaagaaagctttatcagtttagtagcagcaagaacaacaggggaaaacaacacagcagaggtccccaacccccccaggctgcctgtccctgacctgttcaggacctggctgcacagcaggaagcgagcggcaaacctaccctgagcaccgcctcctgtcagatcagctgctgcattagattctcacagcagcacaaactctattgtgaactgcgcatgtgagggatctaggttgcgtgctccttatgagaatctactgcctgattttctgaggtggaacagtttaatcccaaaaccatgcccgccccggcccccatccatgggaaaaaaaccgcatcagtggaaaaattgtcttccacaaaaatcagtccctggtgccaacaaggttggggactgccgaattagaaaaataaggctaacataaacacaaaagaagatgacgacaagtaaatccgaatttattactagttgaaatatatgggatgtagtaaatttaccaaatatttactggattttaaatatccagttctagccaggcgcgatggctcacgtctataatctcagcacttggggaggccgaggggggcggatcacgaggtcaggagatcaagactatcctggccaacacggtgaaacctcatctctacaaaaatacaaaaaattagccgggcatggtggcaggcgcctatagtcccagctactccggaggctgaggcaggagaatggcatgaacccaggaggtgaagcttgcagtgagccgagatcgtgccactgcattccagcctgggcgacagagcgagacttcatctcaaaaaaaaaaaaaaaaaaaaaaaaaaaaaaaaatccagttttaggccaagtgtggtggctcatgcctgtaatcccaacactttgggaggccaaggcaggcggatcacctgagatcaggagttccagaccaccctggccaacatggcaaaacccggtctctactaaaaatacaaaaattagctgggtctggtggcacatgccagtaatcccaactacttgggaagctgaggcaggagagttgcttgaacctgggaggtggaggttgcagtgagccaagatcatgccactgcactccagcctggggcacagagtgagactctgtctctaaaacaaaacaacaacaacaacaaatccagttctatgcactatataacatttagaactcagaaaaggtgtatttcccttgagcatcatgttggtgcttaaaatgtttcagattttggagcattttggattttcagattagggatgctcaacttgtcgtaggtagatatgaccaagagaaagctgaagtagctatacatcagctaaaatggtccctaagatagaatgcattgtaaatgagtcactttataatgaaaaaaggtttaaatcacccaaattgtataatttgaaactgctacctacctaacaaaacagacttgttaaaaacaaatgacagaactatagggaagttttgacaagtctaccatcataatggaagatttcaactattgatcaagcagacaaaaatattagtatagatacagcttttacaatatatacttagatgagtatctgactcctgaaatagaagtgcactgtctcaacaaatgtaaaagagttagtttaggccaggcacggtggctcatgcctgtaatcccagcactttgggaggccaaggcaggcgaatcacgaggtcaggagttcgagaccagcctggccaacatggagaaaccccgtctctactaaaaatacaaaaaattagctgggcatggtgtcggctgcctgtaatcccagctactgaggaggctgaagcaggaaaatcgcttgaaactgggcggcggaggttgcagtgagccgagatggtgccagtgcactctagcccgggcgacagtgcaagactctgtctcaaaaaaaaaaaaaaaaaaaaaaaaagattagtttaatttagaccctagtctttgaacacaatacaattagcagtcaatacaaaatgatacccccacaaaaaatcaatacttttggaaattaaaaaaacacttctaagtaactttataaataaattataaaagtaaaacacttagaagtaaatagtaatgaaaatactatatcaaaacatgggatgcactgatgtctgagaatgtcttaaaaataatacgatgccaagaagagagtgggtcagtattaagatgaattgatcatttattttatattcaaatatcttgcttcagcaagctagttgatggatgcatggcggtttgttatgctgtccaattttgtatatgtttgaaatattctataataaaaaaaggcagagaaagtgggagatagacatttgtagttttaaatacttatatcttaaaggatagactgagtgttaatacactggacactcagtttaaaacattaaaacataacagaataaaccctaaaagagtagagggaagagataacactgtaagaggaataacccataaagcagaaaacaaagatgtaatacagaagatttaaaaaaaggtaaaagttggtgttttaagacaaaataatttggatgttagcctgccacagtggttcatgcctataatccctgcactttgggaggccaaggcagatggatcgcctgagtccaggagtttgaaaccagcttgggcaacatggcaaaaccccgtctctataaaaaaaaaaagagtacaggccaggcgcggtggctcacgcctgtaatcccagcactttgggaggccgaggcgggcggatcacgaggtcaggagattgagaccatcctggctaacacggtgaaaccccatctctattaaaaatacaaaaaattacctgggcacggtggcgggcgcctgtagtcccagctacttgggaggctgaggcaggagaatggcgtgaacccggggtcggagcttgcagtgagccaagatcgcgccactgtgctccagcctgggcgacagagcgagactccgtcacaaaaaaaaaaaaaaaaaaaaaaaaaaaaattacaaaattagctggacatggtgttgtgcctgtagttccatctacttgggaggctgaggtgggaggatggctcgagcctgggaggcagaggttgcagtgagccaagatcacaccactgcactccagcctgggagacagagtgagaccctctctcaaaaatagtaacttggacgtcaatagtaagatttagagaataagagacaaggcggccgggcgcggtggctcatgtaatcccagcactttggaaggctgaggcaggcggatcaccaggtcaggaaattgagactatcctggctaacacggtgaaacaccgtctctactaaaaatacaaaaaattagccgggcatggtggcgggcgcctgtagtcccaagctactcaggaggctgagacaggagaatgacttgaacccgggaggcggagcttgccgtgagctgagatcgtgccattgcactccagcctgggcgacagagcgagactgcgtctcaaaaaataaaataaaataaaataaaataaaaaagagacaagtcaacgataaaattaaaaatgaaaaaacatgtaatagctacagatcctgaataaatttattgttaataccctaaaaactttatgccagccaactgagaccttagatgaaatagacaaatatctggagaataagttaccaaaatgactgaagagaaatacatggctcacacctatattttttacagaaattgacaagggccaggaataatcgaaatactactgaaaaataagaataaagttgtgatggtaatgacttagggaataatgatggttcttgctctgccagatatcaatgtttatttcaaagctatagctataattaatattcataagctaaattaagaattaattcaatattaatttaataaatttaatattttatagctataattaatacagtacggaattagcccaaatgtgaacaaattgaccaacagacacacacagcataggaaaaccagcattatatgttactgaggaaaagaagaggctgagacatttggttattcatatgcagaaaaatgaaattgaatccctaatttatactacatttttgtcagaagtgcaaaacaatttaaatgtttggaagatatgtaggtaaatatctttgtaattccagggttggaaaggatttcttaaatgagacacagaaaaggactaactagaaaagattgatgttccaaccaaattaaaacttgattgtcagcaattacaataagatacaacaaccaaatgcagtttgtgaattttggatggattctggtctttgaaaaaaaatgctactaaaaaaaaaaaccttgtgacaattgatatttgaatatgaatctatgaatatgagtgatggaattttaaattttcttacatataattctgctattgtgggtatgtagaagaatgtggttaagggattattttgatctatgaagtgtcacgatacaagatttaaatcagcaaaaagttagatatacgtgtgtatagatgtgcacatatatatgtatagagagtgaaagtaataaaagtgtatacactgctaaatgttaataactgaatctagctgaaatgtacaccaatgtacaccaatgttttgttttttggttttttttttagagatggagtctcgctctgtctcccaggctggagtgcagtggcgctatctcggctcactgcaagctccgcctcctgggttcacgccattctcctgcctcagcctcctgagtagctgggactacaggcgcccgccaccatgcccggctaattttttttgtatttttagtagagacggggtttcaccgtgttagccaggatggtctcgatctcctgacctcgtgatccgcctgccttggcctcccaaagtgctgggattacaggcgtcagccaccgtgcccggccgatgtacaccaatgttctctgtacaattctttcagattttctgaatgtttgcaaagttttattttaaaaactggagagagagcacttgaaaagatgctcaacatcattagtcattaggaaaatgcaactcaaaaccatgacataccagttcatacctactttgtatgggatagaataaaaaatgagaggcagtaacaagttcggttgaggatgtggggaaactggaaccttagttccagttgctggtgggaacgtaaaatgctgctgccactttggaaaacaatttggcagttcctcaaaaaattaaccagagttaccatatgacccagaaatttcacacttaggtatatacccaacagaaatgaaaacatgtttacagaaaatcctgtacataaatgttcatagcagcattactgatgacagccaaaagtggaaacaagccaaatgtccatcactggatggattaaggaaatgtggtatatcctatacaatggaatattatttggcaataaaaaggaatgaagtacagatacatgctatgacatgaatgaaacttgaaaacattatgctgaataaaagaaaataaaaacagaaggtcatatattctatgattctgtttattaaaatacccagaataggccaggcactgtggctcacgcctgtaatcccagcacctgggggagccgaggcaggtggatcacttgacgtctggagtttgagaccagcctgggcaatatagcaaaaccccatctcaaccaaaatacacaaaaattattggggcatggtggtgcacacctgtggtcccagctactcgagggagggaggagggaagatcacttgagccagggaggttgaggctgcagtgagctgagattgcaccattgcactccagcctgagcaagagtgagatattgtctcaaaaaataaaataaataaaattttaaaaatacgcagaataggcacatctatagaaatatataaagtagaggccaggagaagtggttcatgcctgtaatccgagcactttgggaggccaaggtgggtgcgccacttgaggtcaggagttcaagaccagcctggtcaacatggtgaaaccccacctctactaaaaatacaaaaatacacctgtagtcccagctactcgggaggctgagttacgagaatcccttgaacctgggaggcggaagttgcagtgagctgaaatcatgccactgcactccagcctgggcaacagagcaagactctgttaaaaaaaaaaaaaatagcgagagatcgagagagagtgcacgtgagaagactagtagttgctatggactgggggagaaggaacgggttacagggtttcttttggggataacgaaaatgttctaaaactggactgtggtgataactgcacaactctgtgaatgtactaaaaactactgaactggccaggcacagtggctcacacctgtaatcccagcactttgggaggccctgagatgggcagatcacttgaggtcaggagttccagaccagtctggccaacatggtgaaaccacatctctactaaaaatatttttaaaaattagccaggcatggtggtgcacctgtaatcccagctacttgggaggctggggcatgagaatcatttgaaaccagggggtggaggttgcagtgagccgagatcacaccaccgcactccagcctgggcgacagagccagactctgtctcaaaaacaaacaaaacaaaaacaacaaaaaacacaactgaacacatttaaggtgaattctgtggtatgtgaactatctctaagaacttctttttatttaagttgggaaacaaaaagatcatgtacaacaaaccaaaaacaaaaaagttatttctaacccatgtaacatataacaaggatctagaacatgtaaatgactctttccaatcaataagaagaaaaataacccagtttgtaaaaaatgtgcaaaagacaaatatttcatacaataggaaaaactaaaatgagataattttgtatccattagatggcaaaaattaagaagtctgatgatcctggtaggggtatgtattggtataatcacttgtagaaagttaaatatgcacatactttatgatctaagtgacctcactcctaagtatatacatgagagaaactcttatgcacatatatatgcaggaatgtctgcataatgttgttcatgccagcaaaaatttggaaacaatgaaatatcaataggaaaatggataatttatgatatattcacacaatatacatcataggctagtgaaattataaccacatgcaacaatatggatatatctttaaaatatttaatgaaaaagtatgcttggcgcggtagctcacacctgtaatcccagcactttgggaggatgagggaggtggatcacctgaggtcatgagttcgagacaagagcgaaactgtctaaaaaaaaaaaaaaaaaaaagagtgaagaatcaagccacagaaggtaatttaaaaatgtacactcaagatttaaaaagaactacaattccataagaaaaaggcaggccacagaataggaaaaagaataaaagacttgtttaggcatttcacaaaagaaagtatacaaatttaagtagttatttaaaccacaatgccattctactatatgggcaaccagaagggccaaaacaaaacgaacaaaagactaccaagtgttaacaaggatttaaggcaactgaaacttccagtcattgctggtgggggtatgaattggtacagtcgctttggaaagctactgagcagtatgtactaaagccagacatatgcgtatttctgaaccaggagtttcactcctaggtatgtactcaaaagaactgtgtacactatgttcaccaaaaaacaagaatgtttatagcaaccctctttgcattagtcaaaagctagtaattacccaaaagttcctgaatggtagaatgaattactaaattgtagtattttcatacaatggaatactatacagcaatgagaatgaataaattacaatataaacaacaatatggatgaacattacataattttgaatgaaaggagccagacacaaaaaaaggatatactgtacaattccatttatacgaagcataaaatcaggcaaaaatctataaatctgtcctgccagaagtcagtggttttccagactcgaaggcaggtacaagcacagttagggtgctggtaacattctgtttaaactctgttctgctggttacatgggtatgttcacttgaaaatccatcaagttttatcctcatggtttgtgtacttttctgtatatatgtttcacttcaataaagtttatttttggtc

SEQ ID NO: 197498 - DNA, 3559 bp, Homo sapiens
  Payload ID: 18952
  Gene Name: ubiquitin specific peptidase 8
  Uniprot ID: P40818
  ENST ID: ENST00000425032
  CDS Start-End: 194-3232
aaatcgggaaaagggggtgagctgggctggcttccgtcctggtagccaaggctaattctccctcgagttcttgggagatgggcatttggcgagaaggctggcgttagtgaagcgcgcccggcgtcacggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatgg

SEQ ID NO: 197499 - DNA, 1449 bp, Homo sapiens
  Payload ID: 18952
  Gene Name: ubiquitin specific peptidase 8
  ENST ID: ENST00000560730
  CDS Start-End: 166-576
ggcttccgtcctggtagccaaggctaattctccctcgagttcttgggagatgggcatttggcgagaaggctggcgttagtgaagcgcgcccggcgtcacggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcatgtattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaa

SEQ ID NO: 197500 - DNA, 652 bp, Homo sapiens
  Payload ID: 18952
  Gene Name: ubiquitin specific peptidase 8
  ENST ID: ENST00000560297
  CDS Start-End: 363-652
gcaatgcaaatcgggaaaagggggtgagctgggctggcttccgtcctggtagccaaggctaattctccctcgagttcttgggagatgggcatttggcgagaaggctggcgttagtgaagcgcgcccggcgtcacggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaa

SEQ ID NO: 197501 - DNA, 432 bp, Homo sapiens
  Payload ID: 18952
  Gene Name: ubiquitin specific peptidase 8
  ENST ID: ENST00000559242
  CDS Start-End: 49-237
ggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgaga

SEQ ID NO: 197502 - DNA, 410 bp, Homo sapiens
  Payload ID: 18952
  Gene Name: ubiquitin specific peptidase 8
  ENST ID: ENST00000560982
  CDS Start-End: 192-410
ctcgagttcttgggagatgggcatttggcgagaaggctggcgttagtgaagcgcgcccggcgtcacgctgctggttaccccggagacaagctctgtccgcggagaggagtgggacaactcctaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatc

SEQ ID NO: 197503 - DNA, 815 bp, Homo sapiens
  Payload ID: 18952
  Gene Name: ubiquitin specific peptidase 8
  ENST ID: ENST00000561330
  CDS Start-End: 32-409
tgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagtggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaa

SEQ ID NO: 197504 - DNA, 1917 bp, Homo sapiens
  Payload ID: 18952
  Gene Name: ubiquitin specific peptidase 8
  ENST ID: ENST00000559329
  CDS Start-End: 478-1917
gagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaa

SEQ ID NO: 197505 - DNA, 498 bp, Homo sapiens
  Payload ID: 18952
  Gene Name: ubiquitin specific peptidase 8
  ENST ID: ENST00000558091
  CDS Start-End: 93-498
gcatttatatagcagatgaagaatcaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaac

SEQ ID NO: 197506 - DNA, 609 bp, Homo sapiens
  Payload ID: 18952
  Gene Name: ubiquitin specific peptidase 8
  ENST ID: ENST00000561211
  CDS Start-End: 87-275
tgaagcgcgcccggcgtcacggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctga

SEQ ID NO: 197507 - DNA, 1568 bp, Homo sapiens
  Payload ID: 18952
  Gene Name: ubiquitin specific peptidase 8
  ENST ID: ENST00000625664
  CDS Start-End: 294-482
ggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatgg

SEQ ID NO: 197508 - DNA, 12401 bp, Homo sapiens
  Payload ID: 18953
  Gene Name: ubiquitin specific peptidase 9, X-linked
  Uniprot ID: Q93008
  ENST ID: ENST00000324545
  CDS Start-End: 634-8346
gcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatctttttgattgttttaaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaagaggactgcatattaaaattcattctgtgcatagcatgcctaggcatgacactgattcaggatttcagtcacatcaagtttttgtgcacagaaagatttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaagctttgggtatcttatttgtagtactgtatagtcaacctgtgcttctaggtgttcctgtaggacattttgacaccgatactttgagtgaaagtcacacacggtgtttgcaattccaactgatttttgttttgtttttatttttttgttgttttcttctttgagatggagtcttgctctgtcacccaggctggagtgcagtggcacaatcttggctcactgcaacgtcgcctcctgggttcaagcgattcttccgcctcagcctcccgagtagctgggattagaggtgcccaccaccacgcccagctaatttttgtatttttgtagagacagggtttcaccacgttggccaggctggtcttgaactcctgacctcaggtgatctggccgcctcggcctcccaaagtgctgggattgcaggtgtgagccaccgcgcctggccccagttgatagtttttttaatttaaaagttcctcaattccaagctctttaaacgagtgaaataggttaactttatttggatgagttaggtgtaccatctcaccatctgagaggagatttatatatttcctgctgctccttaacaaaatatgtaatgtacttaaaaactttaacgacttcctagttgagagaaaacttgacatataaaaggctgtgaatttttctgcttggaggaagagcccaaccttggttgctttgaagttacaagcccccttgtgccaggtgaggggcttgtgagtcatttttgtctccatttgaggaagagtggtattcgttgtgactaggagcaagggaaagtggagttatttttgtttgtgcaaattattttctatatttaactcaagcattaatgtataaccagaaatttaaagatgcatgttgttgcaagagcaacataatggtgattttgaggtctttttctgaacacaagtggcacattttaaatttcaagtcttcaaagtgcctaaggattatttagttctccctcaactgattttttgagccatatatttcctattttaaatgtttgcggaatcgccagtcttcctttgaaagaaacagcccccagaattctaaatgacacgattatagaagacagtagaatgtgttaccataaagactgaagatattttagttgtaaaaccatgtgaacaagggcttttgccctattgtatctaagtatttcagtgcacaacttgttaaaccatgttgctgctgtttctaagccctccaccaactgaactttcatgtttagcattgtagaggcagaaataacatactaggttttttttttctttcattgatttttctcctggtgataatttcccagccttgtgtcttttagctgttgtgtatacaaatttagaattaaaatgttttctatttttttcatgattaacttagtgaataacttaaatccttaatcctcgtagtggttagaaagatgaggagacttttttgacttacatttgtaaatgaaaacaagtctgtgaatattcagatgactacttcgaagtaattcagtttttttattagtatttttccagcttatgttttcccatgagctattttactttgctgaattttgtgggtaatttggtggatatatcctgccttatttaggattatagctggataagaaaattgccttttcattgtaagtgcccagttttggtctctagtttgaaggtactacatactgccgataaaggaaaacactcccctacaccccagtttttgtgttaccaagaaaaaaaaaacagtattggtttcatagtaggactcaaccagaattggtcctacatatatgtgagtgttcagtttttgcaaataaggtttttgagtgtgataaaacactacagaagtgctaagtgtattgagaatttgctgctgattgtatttataacaattacttgacgtttgcagaaatttagcactttccctccaaatttataggtgtaagagaagcgggggcaaggtgcaccacattttaaaactgcaaatgtgtgaaaatttatttagagattcagattcctaaaaggaaatttcaccacccaagtcatgcacttcttagccttttacaagccaacagactgacatgaagattgttcacagttcctaagatttagcacatatacaaaaataaaactttataaattcaa

SEQ ID NO: 197509 - DNA, 8371 bp, Homo sapiens
  Payload ID: 18953
  Gene Name: ubiquitin specific peptidase 9, X-linked
  Uniprot ID: Q93008
  ENST ID: ENST00000378308
  CDS Start-End: 634-8298
gcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatctttttgattgttttaaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctgg

SEQ ID NO: 197510 - DNA, 548 bp, Homo sapiens
  Payload ID: 18953
  Gene Name: ubiquitin specific peptidase 9, X-linked
  ENST ID: ENST00000462850
  CDS Start-End: 1-139
aattctgtggaaggccaaaaagatgcataaggttattgtagtagagcatttggtatatagaggaacatttccagcctgttccaagaaagaggtgttagaagaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacct

SEQ ID NO: 197511 - DNA, 10036 bp, Homo sapiens
  Payload ID: 18954
  Gene Name: ubiquitin specific peptidase 9, Y-linked
  Uniprot ID: O00507
  ENST ID: ENST00000338981
  CDS Start-End: 946-8613
tgaataattgaactttgtttatttctccatatttttgcagtggtaattccattataaaacctaatgaaacaatgtttttatagatggtgtggaaagacttttctgggctcagaggtgaaactgacccttgtgtatcagcagcatttctgactgactgagagagtgtagtgattaacagagttgtgatgttagttaagaaacttagatttgccattgtagcttttctaccaattagcagattgtttaactcactgaaattgtaaagtggtagacgtggacttagtcattactgggcagcttatgaattgtattcatttactcatgatgtaaaaatggttagtctccacttttaaggctctagttctagtggctaaataggtacttatttatacagtatgataactgctgtattaaaatacatgtctcaaatgtggaatagtagaagaggtgaagaaaatcatagtttgaggtagaatactgtttgctggtcttaaaaactgtggtattttggtgattccataaattaggtcagatacttccactggagggaaacagtttaaaggatatatgtgatactattaatagaatgaggaagacacaccagatatttaggagggaattagcgagcttgaaactaagagctggtttgaatgagactgggtcataagtgatttcaagtaccagattaaggcactgagattttatttttaagcactgaagtcagattttttccttttaaaagaaaggattcatgatgaaatctgctttttgttttgcagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagatgaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattctacctatgtcgagagcatttcgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaacttggagaaggcaaacttagtccaccccttgactctcttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactagtttttagcccaaatgaagaaataactaaaatttatcagatgaccaccaatggaagcaataagctggaggtggaagatgaacaagtttgctgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccaaggctgcccacataggtatgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacttttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactggtatgatgcactgtgcgttcttctccgtcacagcaaaaatgtacgtttttggtttactcataatgtcctttttaatgtatcaaatcgcttctctgaataccttctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaaga

SEQ ID NO: 197512 - DNA, 909 bp, Homo sapiens
  Payload ID: 18954
  Gene Name: ubiquitin specific peptidase 9, Y-linked
  ENST ID: ENST00000453031
  CDS Start-End: 1-713
aattattgaagactgcagtaactcagaggataccatcaaattacttcgcttttgctcttgggagaatcctcagttctcatctactgtcctcagcgaacttctctggcagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacaga

SEQ ID NO: 197513 - DNA, 3814 bp, Homo sapiens
  Payload ID: 18955
  Gene Name: ubiquitin specific peptidase like 1
  Uniprot ID: Q5W0Q7
  ENST ID: ENST00000255304
  CDS Start-End: 343-3621
agggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaaaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgt

SEQ ID NO: 197514 - DNA, 4074 bp, Homo sapiens
  Payload ID: 18955
  Gene Name: ubiquitin specific peptidase like 1
  Uniprot ID: Q5W0Q7
  ENST ID: ENST00000614860
  CDS Start-End: 369-2660
gcgagtgggggaggagcagtccgaggggaacgtgggttgaacgttgcaactagggtggagatcaagctggaacaggagttccgatcgacccggtaccaagaaggggagtgcccgcggcagaattttgattcagctaaagttccatcagatgagtattgccctgcttgtagagagaagggaaagttaaaagccttaaagacttaccgaattagttttcaagaatctatctttttgtgtgaggatctgcagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgttctcctttttggtttcattttgttcttgtgagagtatgaggatttcaaaatgttaaagatgaaaagtggcgtctagtttctgacagtttgtacagttggatgcattacatttttagatttgaagttttggttatgttagtgttatgagtgatctttgtggtggttttcttcccctggaaacctgttgctcgtggcgctttgcccacggtgcccgagttcttgtcctgtgtccagatatgcagacaaatgaagggtgaagaagaagaagaggagctttatttagtgttagaacagctcagaaggagacccacagtgagcagctcccctgtgtcggcgggcaggtcgtccctcaagtgttcagctctcagcagagaaaaggccctggagagggtgactcctctcagctctcagcagagaagcagccctggagaaggtagcttctgttcgcaggcagattgtccagaggtcctgctgctctcagacggggccctggagaggatagcttctatccataggcaggttgttctgccgtctctacaggtctctgaagctcttagcagagagggtagctcctccctgttgctggtcgtcccaccctctgctcagttctggctgagcctggggcattttacgggcctcgggggaggaagtgcatacttactggcctggaaaaggcaccagttcccactcctacaggtgggactggcagcctggccctcagccttcaggccctccctgttcatggcttccaggcttacccccctgctttgatctgagagctggtgccaatagcagggagaagccaagctgcagaggcaagcacttccgagcctgcaaaagcaggcccccaaaagtgcagggatgcctgagtctgcacccgcacccaggagggtggagatcttgcctgctccaaggctgcagccggaatgatagcaggctgactggagcacctgccaccatcattagttcaagagtttatgcagatttaagttgtatacggtatatgaatgtgtgacagttttccttatggttgtgtggccttctgtaagagcctacgcctgtttgttacaccggtagagtgctgtggaatgtaaactttccctatgtcacttatctcctttatctctccatacagaggagggcaagaaaccttgttacttgaactttagtaatgttaagtgatcaataaatctataaataaatgatagcagaaaaaagtta

SEQ ID NO: 197515 - DNA, 6103 bp, Homo sapiens
  Payload ID: 18956
  Gene Name: ubiquitination factor E4A
  Uniprot ID: Q14139
  ENST ID: ENST00000252108
  CDS Start-End: 132-3332
taacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 197516 - DNA, 6061 bp, Homo sapiens
  Payload ID: 18956
  Gene Name: ubiquitination factor E4A
  Uniprot ID: Q14139
  ENST ID: ENST00000431736
  CDS Start-End: 73-3294
cgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgactt

SEQ ID NO: 197517 - DNA, 2149 bp, Homo sapiens
  Payload ID: 18956
  Gene Name: ubiquitination factor E4A
  ENST ID: ENST00000545354
  CDS Start-End: 466-2082
gtataagtagaggaagaaaacagcaactcagtcatagaaagggacactaagaatagcaatttttaatgccttctcaagatacctgaattgatgcagagcatttttcaaaactactcagtcaacacattgccggaagaaggaaattatgtctttagagagaaatctccatcatagacattttaaataagacagtagataaaagttcagcatgtgcttaagctgctcagctgcctagattcaaacaaaaaatgaatatcatctagtttcccaatattagctagctcaagacattatctacagggccaaaggaaatgattttggactattatccataactttgaattatgtgtcttcctttcagtagagaatattaggctgaccttttctgaagaataatttaatttaatattgaacaacagagagctggaagctgctcttagattgcatctcaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctct

SEQ ID NO: 197518 - DNA, 4772 bp, Homo sapiens
  Payload ID: 18957
  Gene Name: ubiquitination factor E4B
  Uniprot ID: O95155
  ENST ID: ENST00000253251
  CDS Start-End: 840-4361
gacggggtgggacggaggcggggagaggacgcaggcgagaggaactcggcggcgcggcgcccgcggcctattggctgccacgtcccggcgccagaagccccgcctccctgacgggggtcacgtgatccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagtgagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaat

SEQ ID NO: 197519 - DNA, 5267 bp, Homo sapiens
  Payload ID: 18957
  Gene Name: ubiquitination factor E4B
  Uniprot ID: O95155
  ENST ID: ENST00000343090
  CDS Start-End: 76-3984
ctctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggagtagcccatcgaagccagagcagtgaaggagtcagttctctcagcagctcgccctctaatagccttgaaacgcaatctcagtctctctcacgttcccagagcatggatatcgatggtgtctcatgtgagaaaagcatgtcccaggtggatgtggattcaggaattgaaaacatggaggttgatgaaaatgatcgaagagaaaagcggagcctcagtgataaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaagatgtgcagccagccagcagtcagccagcttctgagcaacatccgctcacagtgcatatcccatactgctttagtactacaaggctccctaacacagcccaggtccttgcagcagccgtccttcctagtgccgtatatgctgtgtaggaatctcccatatggcttcattcaggaactggtgagaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttgcttctttgcggttgtggttgccgaaatccttaagtcctggctgtgggcgggagctgcagagactctcttacttaggggctttctttagcttctcagtctttgcagaagatgatgttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaagaaactggtacggtgcaaggcctgtgctgatgctggcctacttgacgagagcttcctgagaagatgtctgaatttttatggccttctcattcagctgctgctccgcatcctggaccccgcatatcccgatataacactgcctttaaattcagatgtccccaaggtatttgcagcgttgcctgagttttatgtagaagatgttgcagaatttttattttttattgtacaatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacagatgttgagcataccggagccaccagtgagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaagaaa

SEQ ID NO: 197520 - DNA, 1273 bp, Homo sapiens
  Payload ID: 18957
  Gene Name: ubiquitination factor E4B
  ENST ID: ENST00000377153
  CDS Start-End: 398-700
taggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggtttaggtattatctctgatgacaagatgattaagactgaatttggttctgctgattttatgaatttggttgatggttttaagataaaataatctgaaaatgcaagattaaaataatggtcaaaatgaacacctctaattgcagatttcctcgtcttcattctgcattggcacagaactttttctttaacttttcagaggataaaactacctgataggatgtttagaactatctcattaaaaagtaaaagtttatttctttataataaatgagctgatgcttgatatccaggactgtctttgttgggaaatgatatttctcatactgtgtatttgaaaatatctctcttttgtctgtgaacttttctatcaaatatagtattattgtcatataataataattactattttataattaggattctagttgcgtaaagggggtgctaagagaactgcattgatcataatatcatctaataatttgatagccttctgaatcatctgtcttcttgatctagaatcgtgtcaattaaaagtatttgcagagtttttgttgctgtacttctcgttaggtatcagtgtagactatagatatatataaatgtttatacctaatgtggttcaaccaaaacatctgttagtaataaagaagatccttgcctataa

SEQ ID NO: 197521 - DNA, 827 bp, Homo sapiens
  Payload ID: 18957
  Gene Name: ubiquitination factor E4B
  ENST ID: ENST00000470736
  CDS Start-End: 1-827
gaaccactcaccaggatgaagaagtgttcaagcagatatttatccccattttacaaggcctggctcttgctgccaaagagtgctccctcgacagtgactactttaaataccccctcatggcactaggtgagctctgtgaaaccaagtttgggaagacacaccctgtgtgcaatttggttaaagtggttgaaaaatacttctcagggcctgccattaccctggaaaacactcgtgtggttagccaatcattgcagcattacttagagctcggaaggcaagagctttttaagattctgcatagtattttgttaaatggcgaaacccgtgaggctgctctcagttacatggcggctgtcgtcaatgccaatatgaagaaagcacagatgcagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctatggcgatcagcctccattttctgagccgaaattccctacggagtgcttctttctcaccctgcatgctcaccacctctctattctgcctagttgccgtcgctatatccgcagactccgggctatccgggagctcaatagaactgtagaagatttgaaaaataatgaaagccaatggaaagattccccactggcaactagacaccgcgaaatgctgaagcgctgtaaaactcagcttaag

SEQ ID NO: 197522 - DNA, 560 bp, Homo sapiens
  Payload ID: 18957
  Gene Name: ubiquitination factor E4B
  ENST ID: ENST00000488228
  CDS Start-End: 1-295
agatgttgagcataccggagccaccagtgagttttatgacaagttcacaattcgctatcatattagcaccatttttaaaagcctttggcaaaacatagctcaccatggcacctttatggaggagttcaactccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccggagcctgcagtgcagtacctgattgtatccatgagtcaaacagctcttattatctcctccccagcccatggcagagttgaaggaggaaagtgcgccagaggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggagcttggaccccgattggctgcaatgctgaactttaatcttcagcaacttt

SEQ ID NO: 197523 - DNA, 2536 bp, Homo sapiens
  Payload ID: 18958
  Gene Name: ubiquitin-conjugating enzyme E2 variant 1
  Uniprot ID: Q13404
  ENST ID: ENST00000340309
  CDS Start-End: 380-892
gcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197524 - DNA, 1973 bp, Homo sapiens
  Payload ID: 18958
  Gene Name: ubiquitin-conjugating enzyme E2 variant 1
  Uniprot ID: Q13404
  ENST ID: ENST00000371657
  CDS Start-End: 12-329
agcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagagtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197525 - DNA, 2133 bp, Homo sapiens
  Payload ID: 18958
  Gene Name: ubiquitin-conjugating enzyme E2 variant 1
  Uniprot ID: Q13404
  ENST ID: ENST00000371674
  CDS Start-End: 46-489
gggggggtgaagaaggggccggccttcaagcaagagcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197526 - DNA, 2459 bp, Homo sapiens
  Payload ID: 18958
  Gene Name: ubiquitin-conjugating enzyme E2 variant 1
  Uniprot ID: Q13404
  ENST ID: ENST00000371677
  CDS Start-End: 303-815
gcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttgcaatcctatgaggttgatactactatcctcatagaaggggaaactgatgccaggagaggttcaagcgtcttacctgaagtcacaaagcaaactgagtgatgaaggaagacttgaacctagaaaatttcactgcaaaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197527 - DNA, 1956 bp, Homo sapiens
  Payload ID: 18958
  Gene Name: ubiquitin-conjugating enzyme E2 variant 1
  ENST ID: ENST00000420027
  CDS Start-End: 1-312
atggagaagggacttaatactaaaaacttcactgaacaaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197528 - DNA, 2387 bp, Homo sapiens
  Payload ID: 18958
  Gene Name: ubiquitin-conjugating enzyme E2 variant 1
  Uniprot ID: Q13404
  ENST ID: ENST00000415862
  CDS Start-End: 432-743
gcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaagacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197529 - DNA, 1155 bp, Homo sapiens
  Payload ID: 18958
  Gene Name: ubiquitin-conjugating enzyme E2 variant 1
  ENST ID: ENST00000483534
  CDS Start-End: 383-652
cccgcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagatttcagtttatatatttgaacctcctctgatgctgtttaacccctctaaatgacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaa

SEQ ID NO: 197530 - DNA, 2258 bp, Homo sapiens
  Payload ID: 18958
  Gene Name: ubiquitin-conjugating enzyme E2 variant 1
  ENST ID: ENST00000557021
  CDS Start-End: 297-614
gcatcagggccgggggacgggtaaggggggggtgaagaaggggccggccttcaagcaagagcgacgcaagatggcagccaccacgggctcggttttatgtttgctacaggagacttaatccagtatagctgaataatccagttggctgctgtgcagatgaaaatgccagtgttttccaaacaagcagttcaagagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197531 - DNA, 2432 bp, Homo sapiens
  Payload ID: 18958
  Gene Name: ubiquitin-conjugating enzyme E2 variant 1
  ENST ID: ENST00000617119
  CDS Start-End: 471-788
gcatcagggccgggggacgggtaaggggggggtgaagaaggggccggccttcaagcaagagcgacgcaagatggcagccaccacgggctcggctggaacagtgctgagtcaattcatttaccatgacgctgccccaggcactcccagaagagagattctgagtcaggccagactgctgggtaaaacttctcaccagaataacactcctaccgggtcgtaataaacgaaggggcccagtgtgctggtggtagccagcaataaggtgctgttgcagctcagccctgcttgcagtcactcggttggctacctacaatctgggttaacagctgcccggttctaacttctccagaccctgacagttaaaaagagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197532 - DNA, 2297 bp, Homo sapiens
  Payload ID: 18958
  Gene Name: ubiquitin-conjugating enzyme E2 variant 1
  ENST ID: ENST00000625172
  CDS Start-End: 336-653
gcatcagggccgggggacgggtaaggggggggtgaagaaggggccggccttcaagcaagagcgacgcaagatggcagccaccacgggctcggcctggtcaccagccaggggcagtatccacccacattactgagggaggagccaaaagccaagggagactggtgatgctcggactagagcccaggcatttttaactcctgttccctcaccagcctgcaggaaatggaaaaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaa

SEQ ID NO: 197533 - DNA, 4373 bp, Homo sapiens
  Payload ID: 18959
  Gene Name: ubiquitin-conjugating enzyme E2 variant 2
  Uniprot ID: Q15819
  ENST ID: ENST00000523111
  CDS Start-End: 56-493
gacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgtagcctgccatcaaaactgtatcaactcttttaatgagcatgtgactgtattaggtacattttgaagaatataagtactgatgataaagtctagtatgcataataggattttggaggcatttcaggaattttccttttatagtatgctttttaggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatgaattgttgataggaacattagcagttaatttttacctgatactgagtttactgtaaaataggaaatgcataggaaggaatacctcctaaataatatgccttatagaatgatgaaatcttaccatagttcatactgaaaatgttgtttatttaaaagtattgtggagtgttgaaaataaagatacacaataagtattttctgaagagaaaattaatgaaggtatttaatgatataggaaataagtgacaagttaaagtccattttgtttcaataaaggagttgtgcaaactcaa

SEQ ID NO: 197534 - DNA, 1322 bp, Homo sapiens
  Payload ID: 18959
  Gene Name: ubiquitin-conjugating enzyme E2 variant 2
  ENST ID: ENST00000521346
  CDS Start-End: 353-670
gtgcgtgcgggcggctgcgtcgggctgcaggagaagatggcggtctccacagagtcactcatgtggttgcatcagctggtgaagggataggcttgttgcccgggacgccttgctccccctccctgcagcctctccaggtggccagttaggacttcctcacatcccggtggtgtcagggtgttcagaattcttacatgatggttggcttccaaaagaacgaaagcagaagttagcattcctcttacaaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaa

SEQ ID NO: 197535 - DNA, 2450 bp, Homo sapiens
  Payload ID: 18959
  Gene Name: ubiquitin-conjugating enzyme E2 variant 2
  ENST ID: ENST00000520809
  CDS Start-End: 1391-1708
ctgaataaactcttaaaaagcagacacactttacttgtgtaaacactcttcttttttttttttttaaatggaatttctctcttgttgcccaggctggtgtgcaatggtgtgatcttggctcaccgcaacctccacctcccgggttcaagcgattctcctgcctcagcctcccgagtagctgggattccaggcatgtgccaccatgcccggctaatttcgtatttctaatagagatggggttcctccatgttggtcaggctggtcacgaactcccaatctcaggtgatctgcctgcctcggcctcccaaagtgctgggattacaggcccagccgtatccactcttttaaatttaggcatccatgtcactggaattatgtttttcacaggatcacttttaaattcattaagaagtttctttatgtatataagcctattcattttacttgaaaggttttctgtcttcccaaagtcaaatccttactaactaaaattaggaattttgaaaaaccatccatgaaaatctcacaaacacattaaaaaatgtattatctaaggtgcataaaattaaactccatattaccaatagcatttaagaaactcatataaaatgataatgttttctttaaagagacatactgaaagccaagtcagttgttcacaggaggtggttttgcaccattatttgaactttgatgtgtgaatttgctttagaagtccatggtctgtttactctctgacagattctgttttcacatgcccctcacatgaaggttcactcctcattcttttttttttttttttgagacaggttgggtgggactgcttcaggattctaaaagacagtaccttctggtgcactttctaagatggaacataattctactctttgaaaatcattagagagtatatattaatgaactttggcttctatgaactttctgggcatgcctgtttgattggtgcagagtccttggctgtaacagaaacatcaaatagggaaaacgatttccttatggttgattgacttacatcagtataaaattgatgaggaatttatatacacgttgtatactgctgttaatgtttggtacagtgctttctttagtgttttcattttgaggggttattagattcagcattttctggagcagaatgctttttaaaggggatttggtctttttgggaaataatttataaaggttaatttggaaaaagctgaatttaaatacgtgtagctcttataattatgagctttttacatttacactgacgttcttttgtataggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcag

SEQ ID NO: 197536 - DNA, 612 bp, Homo sapiens
  Payload ID: 18959
  Gene Name: ubiquitin-conjugating enzyme E2 variant 2
  ENST ID: ENST00000517630
  CDS Start-End: 226-543
gaagatggcggtctccacaggtcggttcccgggccgggctgcgtgattttccgctccgacccggctctgcccctccgtctgctgctggcgcccgagcgctgaccgtgcgggagaagcccgagagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatc

SEQ ID NO: 197537 - DNA, 918 bp, Homo sapiens
  Payload ID: 18959
  Gene Name: ubiquitin-conjugating enzyme E2 variant 2
  ENST ID: ENST00000523432
  CDS Start-End: 1-329
gtgcgtgcgtgcgggcggctgcgtcgggctgcaggagaagatggcggtctccacagacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaac

SEQ ID NO: 197538 - DNA, 735 bp, Homo sapiens
  Payload ID: 18959
  Gene Name: ubiquitin-conjugating enzyme E2 variant 2
  ENST ID: ENST00000518360
  CDS Start-End: 1-463
gctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatgagtctcactctgtcacccaggctggagtacaattgtgcgatcttggctcactgcaacctctgcctcccggcttcaagtgattctcctgcctcaacctcccgagtagctgggattacaggcacctgccatcatgcccagttaatttttgtatttttgtagagacggggtttcacaatggccaggctggtctcgaactcctgaccttagttgatccgcccggctcggcctcccaaagtgctgggattacaggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaa

SEQ ID NO: 197539 - DNA, 625 bp, Homo sapiens
  Payload ID: 18959
  Gene Name: ubiquitin-conjugating enzyme E2 variant 2
  ENST ID: ENST00000520595
  CDS Start-End: 1-158
gagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggctggaataattgaggaaggctgaacagtggaggaagttgcctttggaatgatccctaaaggactgactggtaggatttcagaaggtggtgatggggatggagaacattccagatagagaggagaaaagacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatg

SEQ ID NO: 197540 - DNA, 4290 bp, Homo sapiens
  Payload ID: 18960
  Gene Name: ubiquitin-conjugating enzyme E2, J1
  Uniprot ID: Q9Y385
  ENST ID: ENST00000435041
  CDS Start-End: 280-1236
ccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcata

SEQ ID NO: 197541 - DNA, 1733 bp, Homo sapiens
  Payload ID: 18961
  Gene Name: ubiquitin-conjugating enzyme E2, J2
  Uniprot ID: Q8N2K1
  ENST ID: ENST00000349431
  CDS Start-End: 221-1000
cggaccgcgcaccggaagcagaagctaggctggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcag

SEQ ID NO: 197542 - DNA, 2387 bp, Homo sapiens
  Payload ID: 18961
  Gene Name: ubiquitin-conjugating enzyme E2, J2
  ENST ID: ENST00000347370
  CDS Start-End: 475-1098
ggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccggggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccggcccgggtgttcgctgtccacggaacatggcagaggggcaccccggcccggaaagacgccagagccagcaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctg

SEQ ID NO: 197543 - DNA, 1047 bp, Homo sapiens
  Payload ID: 18961
  Gene Name: ubiquitin-conjugating enzyme E2, J2
  Uniprot ID: Q8N2K1
  ENST ID: ENST00000360466
  CDS Start-End: 229-1008
tccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcacc

SEQ ID NO: 197544 - DNA, 1057 bp, Homo sapiens
  Payload ID: 18961
  Gene Name: ubiquitin-conjugating enzyme E2, J2
  ENST ID: ENST00000400929
  CDS Start-End: 216-839
tggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggt

SEQ ID NO: 197545 - DNA, 1021 bp, Homo sapiens
  Payload ID: 18961
  Gene Name: ubiquitin-conjugating enzyme E2, J2
  Uniprot ID: Q8N2K1
  ENST ID: ENST00000400930
  CDS Start-End: 169-996
atcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggttcaagcgattctcctggctcagcctcctgagtagctgggattacaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcg

SEQ ID NO: 197546 - DNA, 1056 bp, Homo sapiens
  Payload ID: 18961
  Gene Name: ubiquitin-conjugating enzyme E2, J2
  ENST ID: ENST00000435198
  CDS Start-End: 469-1056
cgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgaggtcggttacggcgggctcccggagctccgggtcagggtcatgtcggggacttgaccactcggccgggtttcccgtcagctgggacacttgcagctgccccaggacgggcagcctcgatcctgatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcac

SEQ ID NO: 197547 - DNA, 643 bp, Homo sapiens
  Payload ID: 18961
  Gene Name: ubiquitin-conjugating enzyme E2, J2
  ENST ID: ENST00000422076
  CDS Start-End: 340-643
ggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgagatgagcagcaccagcagtaagagggctccgaccacggcaacccagaggctgaagcaggactaccttcgcattaagaaagacccggtgccttacatctgtgccgagcccctcccttcgaatattctcgagtggttcaagcgattctcctggctcagcctcctgagtagctgggattacaggcactatgtcgtccgaggcccagagatgaccccttatgaaggtggctattatcatggaaaactaatttttcccagagaatttcctttcaaacctcccagtatctatatgatcactcccaacggga

SEQ ID NO: 197548 - DNA, 2455 bp, Homo sapiens
  Payload ID: 18961
  Gene Name: ubiquitin-conjugating enzyme E2, J2
  ENST ID: ENST00000450390
  CDS Start-End: 189-320
gttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtgagaaaagatatttcagtgagttgaaaggaaatgtgtttcggcttggtcaggggtccaccttctctggctcacagaggaggcccagcccaggcaggcggaggatacccagggtgaggcggagccccttggccaccagagtgctctctgcccccagtgttgaaaatcacatgtggccccaggacatcgctggcaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccggcccgggtgttcgctgtccacggaacatggcagaggggcaccccggcccggaaagacgccagagccagcaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctgaattt

SEQ ID NO: 197549 - DNA, 886 bp, Homo sapiens
  Payload ID: 18961
  Gene Name: ubiquitin-conjugating enzyme E2, J2
  ENST ID: ENST00000466752
  CDS Start-End: 151-285
gcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccgggagaaaagatatttcagtgagttgaaaggaaatgtgtttcggcttggtcaggggtccaccttctctggctcacagaggaggcccagcccaggcaggcggaggatacccagggtgaggcggagccccttggccaccagagtgctctctgcccccagtgttgaaaatcacatgtggccccaggacatcgctggcaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacg

SEQ ID NO: 197550 - DNA, 767 bp, Homo sapiens
  Payload ID: 18961
  Gene Name: ubiquitin-conjugating enzyme E2, J2
  ENST ID: ENST00000477894
  CDS Start-End: 190-492
ggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggaatcccagttctggatcatctgcaactagggcagccagagtgcgggagtacatctgtagggtgggccctccatcatcgtgtcattgcccatgaccagcgttggggatgccagcaggccgtggtgagataaggcccgggagcaggtgtccagggcgtgttaaagtacttgttacgatgcgtgtgtgtgccttcagctgatctgaagaatatataccaccgagtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctg

SEQ ID NO: 197551 - DNA, 1256 bp, Homo sapiens
  Payload ID: 18961
  Gene Name: ubiquitin-conjugating enzyme E2, J2
  ENST ID: ENST00000464036
  CDS Start-End: 200-517
aagctaggctggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggaatcccagttctggatcatctgcaactagggcagccagagtgcgggagtacatctgtagggtgggccctccatcatcgtgtcattgcccatgaccagcgttggggatgccagcaggccgtggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgt

SEQ ID NO: 197552 - DNA, 530 bp, Homo sapiens
  Payload ID: 18961
  Gene Name: ubiquitin-conjugating enzyme E2, J2
  ENST ID: ENST00000502382
  CDS Start-End: 318-530
ggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagaattgggggaaatagccccctggcctcctgggggacgtgagaatgctgttctgtgtgaagctcaggaagagtggctggggaaacagcagttgaatcgtgaacatgattttaaaagcctctccaagcagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaattt

SEQ ID NO: 197553 - DNA, 472 bp, Homo sapiens
  Payload ID: 18961
  Gene Name: ubiquitin-conjugating enzyme E2, J2
  ENST ID: ENST00000509720
  CDS Start-End: 292-472
gaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggcactatgtcgtccgaggcccagagatgaccccttatgaaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagacccc

SEQ ID NO: 197554 - DNA, 814 bp, Homo sapiens
  Payload ID: 18961
  Gene Name: ubiquitin-conjugating enzyme E2, J2
  ENST ID: ENST00000503294
  CDS Start-End: 169-303
atcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccggggcactatgtcgtccgaggcccagagatgaccccttatgaaggaatcccagttctggatcatctgcaactagggcagccagagtgcgggagtacatctgtagggtgggccctccatcatcgtgtcattgcccatgaccagcgttggggatgccagcaggccgtggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtat

SEQ ID NO: 197555 - DNA, 1028 bp, Homo sapiens
  Payload ID: 18961
  Gene Name: ubiquitin-conjugating enzyme E2, J2
  ENST ID: ENST00000473215
  CDS Start-End: 185-319
cgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccggggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtga

SEQ ID NO: 197556 - DNA, 750 bp, Homo sapiens
  Payload ID: 18961
  Gene Name: ubiquitin-conjugating enzyme E2, J2
  ENST ID: ENST00000488418
  CDS Start-End: 620-750
cgggtcagggtcatgtcggggacttgaccactcggccgggtttcccgtcagctgggacacttgcagctgccccaggacgggcagcctcgatcctggttcgtcagtggatcacgggagtctgtgtcgggggagggctgccgtcgagcccgccgtcgcctcgcccctgaactgttagactccagactgccccgtaaaccccgagagaaacgagcgtgcccgggactgtgcttagggccagcgtttctgggaaacccgggcggtgacagtgggagaccaccgccggccggcgagtgagacacgagcccggaacaagtctctaagcggcgccgggcctcgccatccacacctgccagttccctgcatcctttcagcccctggccaggtgtcacctcctggcgtccttttcagtgcctgccacttagtgcgtgtgtatttaactctagtccggttgccatcctcttgccagacccagataggaagcggctgaaaggtcgggcctcagcccggtgggaggtgggcagcgaagagtgtacagcgggcttggctggggcaggtcggtggccccgcgccctgctccaggggaaccagactgtgtaatctggcttccgaagaaaggatcatgagcagcaccagcagtaagagggctccgaccacggcaacccagaggctgaagcaggactaccttcgcattaagaaagacccggtgccttacatctgtgccgagcccctcccttcgaatattctcgagtg

SEQ ID NO: 197557 - DNA, 718 bp, Homo sapiens
  Payload ID: 18962
  Gene Name: ubiquitin-conjugating enzyme E2A
  ENST ID: ENST00000346330
  CDS Start-End: 177-626
acactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttatt

SEQ ID NO: 197558 - DNA, 1874 bp, Homo sapiens
  Payload ID: 18962
  Gene Name: ubiquitin-conjugating enzyme E2A
  Uniprot ID: P49459
  ENST ID: ENST00000371558
  CDS Start-End: 246-704
gtacggcctgtccggcgctcgacgttccacccccctctctctgctctcaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaatttcata

SEQ ID NO: 197559 - DNA, 1435 bp, Homo sapiens
  Payload ID: 18962
  Gene Name: ubiquitin-conjugating enzyme E2A
  ENST ID: ENST00000631185
  CDS Start-End: 150-521
agaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagatcctctgggtgaagagcctgtatggcattgtgaacttttgacagatggataagtgggctgtgttttttgaagaattttcaaagcctcgtcggcagctgcatgtttacttgttttcttggttccataaccttcagctaagcagtgatcttgtaaaaacactcgacaacgccatgtgcgatttggcatcatctcatatttgtattcaattgacatcttgttgaatgaggcagaattgttaaggataccaattgcatcatttgcattttctgtaatgacaaaattggtccagtgtttggcagaagcattaaaaattggctgcccggaagcatctttacccagcaccaccaggtcttctggtggcttcagagctggaggaaattcataggaggacatgccaatctgacacaccacgaggtcctctccaaatgtatgcttgaatttccgccggacaactctaacttcaatacgtttctgcaagagttttacagctagctctgtagctcgatccctggacccattcttgctgccagcataacctgtagttaagtagatattttggcatctaacttcacaagcatagccatcagttagaagttttttatttttggggatgtcggcaggaggaatttcctttaaaggagcatatatatactcaggatttgtcttacacgcctgaatacaacgagttaacatatatgtataattaattttatcagatccagaagtcatttctggattagaaaggttcttccagattgtcgccgttaatttttcaataaaatactgcttctcggctaccacagactcgggaaatgtctgtgatggtgaaggctcaggagttgactgagagtttgcctgctgtgatgtggtgcttggggcagggttcccactgtcaaaatacatgttggctgttacaggctggtcttttgtgagaatgaatcctgatgaatcacaa

SEQ ID NO: 197560 - DNA, 557 bp, Homo sapiens
  Payload ID: 18962
  Gene Name: ubiquitin-conjugating enzyme E2A
  ENST ID: ENST00000629303
  CDS Start-End: 135-329
ttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatgacggagttgcgccctgtcacccaggctggagtgcgatggtgtgatctcggctcactgcaacctccgcctcccaggttcaagcgattctcctgcctcagcctcctgagtagctgggattacaggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatg

SEQ ID NO: 197561 - DNA, 1771 bp, Homo sapiens
  Payload ID: 18962
  Gene Name: ubiquitin-conjugating enzyme E2A
  Uniprot ID: P49459
  ENST ID: ENST00000630695
  CDS Start-End: 368-601
agaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaatttcata

SEQ ID NO: 197562 - DNA, 1381 bp, Homo sapiens
  Payload ID: 18962
  Gene Name: ubiquitin-conjugating enzyme E2A
  Uniprot ID: P49459
  ENST ID: ENST00000625938
  CDS Start-End: 167-535
ggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattc

SEQ ID NO: 197563 - DNA, 934 bp, Homo sapiens
  Payload ID: 18962
  Gene Name: ubiquitin-conjugating enzyme E2A
  ENST ID: ENST00000628549
  CDS Start-End: 209-568
ttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaac

SEQ ID NO: 197564 - DNA, 2515 bp, Homo sapiens
  Payload ID: 18963
  Gene Name: ubiquitin-conjugating enzyme E2B
  Uniprot ID: P63146
  ENST ID: ENST00000265339
  CDS Start-End: 418-876
cgtccctctttctccaccccgccgagcctaaactagtgacggggagggagacgggatagtgtttctgtttcgtggtctttgaatccacaacctctagtctgaacacagagaacacaaatttgtctattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtctctctagtagttaaaacagctattttagtaaccccaagagtttcttctcatatccataaaattggattacagtatggcaatatctacagcttctattcattatgcaacgtttaacattgattggataaatgcttataggctgggccaggtggctcccacctgtagtcccagcactttgggaggcaaaggcgggaggatcacttgaggccaggactttgagaccagccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacttggcaaa

SEQ ID NO: 197565 - DNA, 644 bp, Homo sapiens
  Payload ID: 18963
  Gene Name: ubiquitin-conjugating enzyme E2B
  ENST ID: ENST00000507277
  CDS Start-End: 1-424
cccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatata

SEQ ID NO: 197566 - DNA, 415 bp, Homo sapiens
  Payload ID: 18963
  Gene Name: ubiquitin-conjugating enzyme E2B
  ENST ID: ENST00000510021
  CDS Start-End: 128-262
agtctcggcggcggcggcggcggcggcggcggcggcgatccacagtgattcggccgccgcgccggggggtgggggggctgcgcgggactttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacg

SEQ ID NO: 197567 - DNA, 500 bp, Homo sapiens
  Payload ID: 18963
  Gene Name: ubiquitin-conjugating enzyme E2B
  ENST ID: ENST00000506787
  CDS Start-End: 1-417
tcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtgtcttgctctgttgcccagactggagtgcaatggcacaatcttggctcaccgcaacctctgcctcccgggttcaatctctgctggatgaaccgaatcctaacagtccagccaatagccaggcagcacagctttatcaggaaaacaaacgagaatatgagaaaagagtttcgg

SEQ ID NO: 197568 - DNA, 476 bp, Homo sapiens
  Payload ID: 18964
  Gene Name: ubiquitin-conjugating enzyme E2C
  ENST ID: ENST00000243893
  CDS Start-End: 39-191
gttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 197569 - DNA, 665 bp, Homo sapiens
  Payload ID: 18964
  Gene Name: ubiquitin-conjugating enzyme E2C
  Uniprot ID: O00762
  ENST ID: ENST00000352551
  CDS Start-End: 23-475
tctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 197570 - DNA, 737 bp, Homo sapiens
  Payload ID: 18964
  Gene Name: ubiquitin-conjugating enzyme E2C
  Uniprot ID: O00762
  ENST ID: ENST00000335046
  CDS Start-End: 62-547
cgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 197571 - DNA, 850 bp, Homo sapiens
  Payload ID: 18964
  Gene Name: ubiquitin-conjugating enzyme E2C
  Uniprot ID: O00762
  ENST ID: ENST00000356455
  CDS Start-End: 121-660
gagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 197572 - DNA, 914 bp, Homo sapiens
  Payload ID: 18964
  Gene Name: ubiquitin-conjugating enzyme E2C
  Uniprot ID: O00762
  ENST ID: ENST00000372568
  CDS Start-End: 302-724
ggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 197573 - DNA, 641 bp, Homo sapiens
  Payload ID: 18964
  Gene Name: ubiquitin-conjugating enzyme E2C
  ENST ID: ENST00000405520
  CDS Start-End: 121-360
gagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacaaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttag

SEQ ID NO: 197574 - DNA, 705 bp, Homo sapiens
  Payload ID: 18964
  Gene Name: ubiquitin-conjugating enzyme E2C
  ENST ID: ENST00000617055
  CDS Start-End: 121-519
gagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatggcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttag

SEQ ID NO: 197575 - DNA, 2659 bp, Homo sapiens
  Payload ID: 18965
  Gene Name: ubiquitin-conjugating enzyme E2D 1
  Uniprot ID: P51668
  ENST ID: ENST00000373910
  CDS Start-End: 228-671
aaacaaaagagtctcgccggcgtccccgcccgcacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgacttgttccactggcaagccactattatggggcctcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggatcaaaactctaaaattttgcatgaaaattacatccaaattgtgaaaatcagatctattttgtttgccattagtcaccattagttatataaattttattgttttaggttagtatctctttactaaattgtcagtctataagataatatatgttgatcccttgctgtagaggagaatttagagtaatttggggtttgtcttggattatatctaaatggattatttgttaaaagtactgaaatgagtataaggcagtatcacccatccaaaagaaaggtctttatagacctgcacagtcactagattaattcattaaaatgcccccaccctgatgtaattgacattacatttcttaacattttaaaatctagaatttctaaaatggaatttaatgccatcacaatttgaaaaactttttttttttttttactatagaagttacaaaggaagttctaaaattatgcctccctctgtttttataagttgccatcgaaaagtgatttaaataagcaggttatctttatagattttaaagaaaactagaaagttttaatgttttaacttggggaaaaatacatctctttaatgtttagcatgcttgtcaaccttgagtgagtgtcatttttaagaacagttgtagcccttctgattattgcagtagctgtagaagtatgtaagaatatgtgatgggtgtagtcattagcaaagcatttaaatcacttgagtattttgtcatggttcattattattaaagcacaaaataacctattgttagaaaatatgtgtttttataaatgaatgtaaaataattaaatgaattgtgaaatggatgtttaagaaaatataggcttaaaaagtaaatctataaaatgatgtcttaaaacagccatatcatgaaaaattctacttagctatattattataagctacatttgccctgaatttgaacactcaacatcactagatttaaatatttagtatattttgatagtaaagggttttgtttcttgaatatcttcactttaaacaaaaaaaaaaaacaactttcatttgtgtggcatttatttttggaagtgtcttcttttttttctttattaaagtttttgaaacttgcctaa

SEQ ID NO: 197576 - DNA, 2621 bp, Homo sapiens
  Payload ID: 18965
  Gene Name: ubiquitin-conjugating enzyme E2D 1
  ENST ID: ENST00000615793
  CDS Start-End: 306-635
aaaagagtctcgccggcgtccccgcccgcacactcgcgcacactcgcgctcgggcgcacacggagcagggaccggcgcccggagcgagccagggagcggctaaccggggacccaccgcgcggagccagcctagctgccagcgagcccaacccgcgacgacccacgcccctgagccccgcagccgacccctgccggccggtgtccccaccgccatccctgacccatggcgctgaagaggattcagaaagaattgagtgatctacagcgcgatccacctgctcactgttcagctggacctgtgggagatgactcctgatagcgcatatcaaggtggagtcttctttctcactgtacattttccgacagattatccttttaaaccaccaaagattgctttcacaacaaaaatttaccatccaaacataaacagtaatggaagtatttgtctcgatattctgaggtcacaatggtcaccagctctgactgtatcaaaagttttattgtccatatgttctctactttgtgatcctaatccagatgaccccttagtaccagatattgcacaaatctataaatcagacaaagaaaaatacaacagacatgcaagagaatggactcagaaatatgcaatgtaaaaatcaaaaacattttcatatataccagagtactgtaaaatctaggtttttttcaacattagcagtaaattgagcactgtttactgtttcattgtaccatgaaaccatttgatttttacccattttaaatgtgtttctgaagcaagacaaaacaaacttccaaaaatacccttaagactgtgatgagagcatttatcattttgtatgcattgagaaagacatttattatggtttttaagatacttggacatctgcatcttcagcttacaagatctacaatgcagctgaaaagcaaccaaattattttttgctgaaactagatgtttttacatgagaaatactgtatgtgttgtctaagatgtcagttttataaatctgtattcagatttcattctttgttagctcactttataatttgtatttttttactgtatagactaaatatattctatttacatgtatgtcaactcattacttttttcctgtgaacagtattgaaaaaccccaacggctgataattaagtgaattaactgtgtctcccttgtcttaggatattctgtagattgattgcagatttcttaaatctgaaatgatctttacactgtaattctcagcatactgattatggagaaacacttgttttgattttgttatacttgacttaactttattgcaatgtgaattaattgcactgctaagtaggaagatgtgtaacttttatttgttgctattcacatttgaattttttcctgtataggcaatattatattgacaccttttacagatcttactgtagctttttccatataaataaaatgctttttctactatttgtcttgattacttaaaaaaataaaaatataagtaaggatcaaaactctaaaattttgcatgaaaattacatccaaattgtgaaaatcagatctattttgtttgccattagtcaccattagttatataaattttattgttttaggttagtatctctttactaaattgtcagtctataagataatatatgttgatcccttgctgtagaggagaatttagagtaatttggggtttgtcttggattatatctaaatggattatttgttaaaagtactgaaatgagtataaggcagtatcacccatccaaaagaaaggtctttatagacctgcacagtcactagattaattcattaaaatgcccccaccctgatgtaattgacattacatttcttaacattttaaaatctagaatttctaaaatggaatttaatgccatcacaatttgaaaaactttttttttttttttactatagaagttacaaaggaagttctaaaattatgcctccctctgtttttataagttgccatcgaaaagtgatttaaataagcaggttatctttatagattttaaagaaaactagaaagttttaatgttttaacttggggaaaaatacatctctttaatgtttagcatgcttgtcaaccttgagtgagtgtcatttttaagaacagttgtagcccttctgattattgcagtagctgtagaagtatgtaagaatatgtgatgggtgtagtcattagcaaagcatttaaatcacttgagtattttgtcatggttcattattattaaagcacaaaataacctattgttagaaaatatgtgtttttataaatgaatgtaaaataattaaatgaattgtgaaatggatgtttaagaaaatataggcttaaaaagtaaatctataaaatgatgtcttaaaacagccatatcatgaaaaattctacttagctatattattataagctacatttgccctgaatttgaacactcaacatcactagatttaaatatttagtatattttgatagtaaagggttttgtttcttgaatatcttcactttaaacaaaaaaaaaaaacaactttcatttgtgtggcatttatttttggaagtgtcttcttttttttctttattaaagtttttgaaacttgcct

SEQ ID NO: 197577 - DNA, 444 bp, Homo sapiens
  Payload ID: 18966
  Gene Name: ubiquitin-conjugating enzyme E2D 2
  ENST ID: ENST00000253815
  CDS Start-End: 1-444
ctgtctctactaaaaatacaaaaagaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaa

SEQ ID NO: 197578 - DNA, 2702 bp, Homo sapiens
  Payload ID: 18966
  Gene Name: ubiquitin-conjugating enzyme E2D 2
  Uniprot ID: P62837
  ENST ID: ENST00000398733
  CDS Start-End: 627-1070
gcttcgcagcgtcacgccctccggggccgtggcggcgacggcggtgcgtagcttactcacaggggcggcccgtatccctccgccgccggcgcggctcggccctccctcccctggcccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataattttgtgtgaataggctttttcatttttaagaagtttgtctagctgagattagtggtggattttctcccacttctgaaatgttcatttatactggttgcattttaagatcatgaaacaattccagttacattgtaaaaaggatatcttacgagtaattttattgaacaagttagaggcataagcttaagagcatttccatgaaacaacacatgcagcattccaggaacttgattgttaaattcaataagaaatttgctttattaatgaaactaagctgcatttcatcaaaaccttgtgacattcccttggtacataggacataaaacacagaggcattgctatttggtaagttaagcttctgtgattgtaattataaaagagcaacattgaccaaacctgggaaacaagagcacagtcttgtttggagagtctacataattactttgcactaacatttgcaggatgttcacacaattttaaattgtactgtatgtggctttttgaagtcttcccttgaccctagtaaaatatagcttgaaacttgtaaacaactgtgtttgccagaaacatcattcatgtgaactaggcaagttaccttttttccccccttcttttcctaattgtaaactaggccaacctgaaagccatggctgatgctctagccatcaggttctttcaaatgcatctttacactcttgcacaaaagttaaggaataaatgtccactgcttttggttttaa

SEQ ID NO: 197579 - DNA, 901 bp, Homo sapiens
  Payload ID: 18966
  Gene Name: ubiquitin-conjugating enzyme E2D 2
  Uniprot ID: P62837
  ENST ID: ENST00000398734
  CDS Start-End: 67-510
gccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtctatttggatgtaagggtgaaaattcatttgatggaaatacttgtgtatatttaaagacccaattgctcctctggagcttgtactttcaagaatgattaatctgtgtaataaactggttactacagtcattac

SEQ ID NO: 197580 - DNA, 1113 bp, Homo sapiens
  Payload ID: 18966
  Gene Name: ubiquitin-conjugating enzyme E2D 2
  Uniprot ID: P62837
  ENST ID: ENST00000505548
  CDS Start-End: 443-799
agcgttcctccccggctgcccttccaggcccgcatggtgtggactcttagggcttctctccagtctgggactgccgctgcacttgagggccattgtcgggccaggatggcggggttggggccgaggggggcgctggggcgttgggcggccccttcgacagaggtcgaaagggcttctcgccccatttctgttccctcctcccacacctgccctagctccctccacaaaaccgcctgagctcgggctgacagaggaagccgttttgcccgatccacaagtatatcctgagttcacttacctcttgggtggcagcacacatcggtccaccctgcttgtccagaaactgttaagagttggaagttcagaagaaaaaaaaaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgagg

SEQ ID NO: 197581 - DNA, 1170 bp, Homo sapiens
  Payload ID: 18966
  Gene Name: ubiquitin-conjugating enzyme E2D 2
  ENST ID: ENST00000505007
  CDS Start-End: 877-1170
cttcgcagcgtcacgccctccggggccgtggcggcgacggcggtgcgtagcttactcacaggggcggcccgtatccctccgccgccggcgcggctcggccctccctcccctggcccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaagctccctccacaaaaccgcctgagctcgggctgacagaggaagccgttttgcccgatccacaagtatatcctgagttcacttacctcttgggtggcagcacacatcggtccaccctgcttgtccagaaactgttaagagttggaagttcagaagaaaaaaaaaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctac

SEQ ID NO: 197582 - DNA, 656 bp, Homo sapiens
  Payload ID: 18966
  Gene Name: ubiquitin-conjugating enzyme E2D 2
  Uniprot ID: P62837
  ENST ID: ENST00000511725
  CDS Start-End: 246-602
catccctgtgggggactccggccagcctgagtgacgcgatccaaagagcgctcccgggtaggaaattgccctggtggaatgcctcgccagagcagcgtgtagcaggcccccgcggaggattaacacagtggctgaacaccgggaaggaactggcacttgggagtccggacatctgaaacttggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaaga

SEQ ID NO: 197583 - DNA, 1087 bp, Homo sapiens
  Payload ID: 18967
  Gene Name: ubiquitin-conjugating enzyme E2D 3
  Uniprot ID: P61077
  ENST ID: ENST00000321805
  CDS Start-End: 464-907
gtagttccgtcagagcggacatcttgtggctgtgtcgtgcgcgtgagccccgtagggccggggaggcaccagctgccgcgcggggaggaggccgaggccgcagcttgagggaggccccggcccctctaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccag

SEQ ID NO: 197584 - DNA, 896 bp, Homo sapiens
  Payload ID: 18967
  Gene Name: ubiquitin-conjugating enzyme E2D 3
  Uniprot ID: P61077
  ENST ID: ENST00000338145
  CDS Start-End: 290-733
gggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaa

SEQ ID NO: 197585 - DNA, 711 bp, Homo sapiens
  Payload ID: 18967
  Gene Name: ubiquitin-conjugating enzyme E2D 3
  ENST ID: ENST00000350435
  CDS Start-End: 118-543
agttgcagcttttcacccgaagctatttatccgagggacaccgggaactgatgtaaaaggcattctggaagctcccttttccttttggctggagagtgggggtggataaggggtgcgatggcagaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagactt

SEQ ID NO: 197586 - DNA, 838 bp, Homo sapiens
  Payload ID: 18967
  Gene Name: ubiquitin-conjugating enzyme E2D 3
  Uniprot ID: P61077
  ENST ID: ENST00000349311
  CDS Start-End: 244-687
ctcgatgcttctctgagcctaagggtttccgccactcgttcaccctccccccagctcatgatcctcctccctcccccgccctcctggtccaatctccgatctgtttagtaagaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatg

SEQ ID NO: 197587 - DNA, 2389 bp, Homo sapiens
  Payload ID: 18967
  Gene Name: ubiquitin-conjugating enzyme E2D 3
  Uniprot ID: P61077
  ENST ID: ENST00000343106
  CDS Start-End: 615-1061
agaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaataggttagcaagagagtggacagagaaatacgctatgttgtagggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtggg

SEQ ID NO: 197588 - DNA, 660 bp, Homo sapiens
  Payload ID: 18967
  Gene Name: ubiquitin-conjugating enzyme E2D 3
  Uniprot ID: P61077
  ENST ID: ENST00000357194
  CDS Start-End: 153-602
cgcggcggactgccgaggcgcgggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgt

SEQ ID NO: 197589 - DNA, 2368 bp, Homo sapiens
  Payload ID: 18967
  Gene Name: ubiquitin-conjugating enzyme E2D 3
  Uniprot ID: P61077
  ENST ID: ENST00000394801
  CDS Start-End: 486-929
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattgga

SEQ ID NO: 197590 - DNA, 2227 bp, Homo sapiens
  Payload ID: 18967
  Gene Name: ubiquitin-conjugating enzyme E2D 3
  Uniprot ID: P61077
  ENST ID: ENST00000394803
  CDS Start-End: 345-788
ccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattgga

SEQ ID NO: 197591 - DNA, 4166 bp, Homo sapiens
  Payload ID: 18967
  Gene Name: ubiquitin-conjugating enzyme E2D 3
  Uniprot ID: P61077
  ENST ID: ENST00000394804
  CDS Start-End: 694-1137
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaag

SEQ ID NO: 197592 - DNA, 3990 bp, Homo sapiens
  Payload ID: 18967
  Gene Name: ubiquitin-conjugating enzyme E2D 3
  Uniprot ID: P61077
  ENST ID: ENST00000453744
  CDS Start-End: 515-958
gttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 197593 - DNA, 604 bp, Homo sapiens
  Payload ID: 18967
  Gene Name: ubiquitin-conjugating enzyme E2D 3
  ENST ID: ENST00000508249
  CDS Start-End: 458-604
gcattttggaggcggaaccccgtcaggaaaagcgcacaaaactgctcttaagtcattgcagagctaccgcttcggttagccagccacgaagttctcgcgagagtcgtctcctcgataccaaaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgta

SEQ ID NO: 197594 - DNA, 680 bp, Homo sapiens
  Payload ID: 18967
  Gene Name: ubiquitin-conjugating enzyme E2D 3
  ENST ID: ENST00000502563
  CDS Start-End: 360-467
cacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgataagttttttttctttttctagtgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttcta

SEQ ID NO: 197595 - DNA, 574 bp, Homo sapiens
  Payload ID: 18967
  Gene Name: ubiquitin-conjugating enzyme E2D 3
  ENST ID: ENST00000502404
  CDS Start-End: 202-558
ccttttggctggagagtgggggtggataaggggtgcgatggcagtaagggaaagctaatagggtggagtgtttacagctaacttgaaaaaaatgtcatggaataaattcagccttactagaaaaattgtggagtgtcggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtca

SEQ ID NO: 197596 - DNA, 582 bp, Homo sapiens
  Payload ID: 18967
  Gene Name: ubiquitin-conjugating enzyme E2D 3
  ENST ID: ENST00000510129
  CDS Start-End: 225-332
gtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgataagttttttttctttttctagtgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatcc

SEQ ID NO: 197597 - DNA, 743 bp, Homo sapiens
  Payload ID: 18967
  Gene Name: ubiquitin-conjugating enzyme E2D 3
  ENST ID: ENST00000505307
  CDS Start-End: 254-400
agttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctataagcaactatatgctggataattgaatattcagaattatggataccatctaagaatttcagagaattagagcgcactaaaacatcctgggaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataa

SEQ ID NO: 197598 - DNA, 568 bp, Homo sapiens
  Payload ID: 18967
  Gene Name: ubiquitin-conjugating enzyme E2D 3
  ENST ID: ENST00000508974
  CDS Start-End: 203-370
agggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctcaaaattcctttctatcctgggtagataagcaactatatgctggataattgaatattcagaattatggataccatctaagaatttcagagaattagagcgcactaaaacatcctgggaatgacagcccatatcaaggcggtgtattctttttgacaattcattttcctacagactaccccttcaaaccacctaaggttgcatttacaacaagaatttatcatccaaatattaacagtaatggcagc

SEQ ID NO: 197599 - DNA, 547 bp, Homo sapiens
  Payload ID: 18967
  Gene Name: ubiquitin-conjugating enzyme E2D 3
  ENST ID: ENST00000508238
  CDS Start-End: 259-547
agcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaaagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctt

SEQ ID NO: 197600 - DNA, 593 bp, Homo sapiens
  Payload ID: 18967
  Gene Name: ubiquitin-conjugating enzyme E2D 3
  ENST ID: ENST00000514755
  CDS Start-End: 217-363
gcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctataagcaactatatgctggataattgaatattcagaattatggataccatctaagaatttcagagaattagagcgcactaaaacatcctgggaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcct

SEQ ID NO: 197601 - DNA, 662 bp, Homo sapiens
  Payload ID: 18967
  Gene Name: ubiquitin-conjugating enzyme E2D 3
  ENST ID: ENST00000503418
  CDS Start-End: 373-519
gagcctaagggtttccgccactcgttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctataagcaactatatgctggataattgaatattcagaattatggataccatctaagaatttcagagaattagagcgcactaaaacatcctgggaatgacagcccatatcaaggcggtgtattctttttgacaattcattttcctacagactaccccttcaaaccacctaag

SEQ ID NO: 197602 - DNA, 577 bp, Homo sapiens
  Payload ID: 18967
  Gene Name: ubiquitin-conjugating enzyme E2D 3
  ENST ID: ENST00000507845
  CDS Start-End: 191-547
cttttccttttggctggagagtgggggtggataaggggtgcgatggcaagggtggagtgtttacagctaacttgaaaaaaatgtcatggaataaattcagccttactagaaaaattgtggagtgtcggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcatt

SEQ ID NO: 197603 - DNA, 601 bp, Homo sapiens
  Payload ID: 18967
  Gene Name: ubiquitin-conjugating enzyme E2D 3
  ENST ID: ENST00000508476
  CDS Start-End: 385-601
gctctaacttctatcccgcattttaagatggcggctgctttaactggttcaggctctttccggcatctcctttcgtaataatgtgaattaatatgatttgttaaatgttaacttttatatcgcgttgtgcactgctctaagatcctctgctcaaaacttacctaaattcaaactcttaaactgtatttcccttttttgtgacttgtatttgtgtgatgtgtttggttgttgcacaatcgaagagggtggagtgtttacagctaacttgaaaaaaatgtcatggaataaattcagccttactagaaaaattgtggagtgtcggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaag

SEQ ID NO: 197604 - DNA, 599 bp, Homo sapiens
  Payload ID: 18967
  Gene Name: ubiquitin-conjugating enzyme E2D 3
  ENST ID: ENST00000502690
  CDS Start-End: 365-599
acaaaactgctcttaagtcattgcagagctaccgcttcggttagccagccacgaagttctcgcgagagtcgtctcctcgataccaataagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatatta

SEQ ID NO: 197605 - DNA, 527 bp, Homo sapiens
  Payload ID: 18967
  Gene Name: ubiquitin-conjugating enzyme E2D 3
  ENST ID: ENST00000505207
  CDS Start-End: 123-479
ccttttggctggagagtgggggtggataaggggtgcgatggcagtaagggaaagctaatgaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaacttt

SEQ ID NO: 197606 - DNA, 578 bp, Homo sapiens
  Payload ID: 18967
  Gene Name: ubiquitin-conjugating enzyme E2D 3
  ENST ID: ENST00000504211
  CDS Start-End: 129-485
gcattttaagatggcggctgctttaactggttcaggctctttccggcatctcctttcgtaataatgaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctccccta

SEQ ID NO: 197607 - DNA, 587 bp, Homo sapiens
  Payload ID: 18967
  Gene Name: ubiquitin-conjugating enzyme E2D 3
  ENST ID: ENST00000508635
  CDS Start-End: 127-186
attttaagatggcggctgctttaactggttcaggctctttccggcatctcctttcgtaataatgaacttagtgatttggcccgtgaccctccagcacaatgttctgcaggtccagttggggatgatatgtttcattggcaagccacaattatgggacctataagcaactatatgctggataattgaatattcagaattatggataccatctaagaatttcagagaattagagcgcactaaaacatcctgggaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaa

SEQ ID NO: 197608 - DNA, 3472 bp, Homo sapiens
  Payload ID: 18967
  Gene Name: ubiquitin-conjugating enzyme E2D 3
  ENST ID: ENST00000618836
  CDS Start-End: 1-447
atgctgagtttaaaaaaaaaaaaaaaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgttt

SEQ ID NO: 197609 - DNA, 3974 bp, Homo sapiens
  Payload ID: 18968
  Gene Name: ubiquitin-conjugating enzyme E2D 4 (putative)
  Uniprot ID: Q9Y2X8
  ENST ID: ENST00000222402
  CDS Start-End: 90-533
cggcgtgcagcttggtggcggctgagccggcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaatgataattgacatttcagcctctttcttttaggcaaaacagaagatacacactattaacagttatttgaagccttaaattacaatagcctgttaggtgatcggctttctgccttggctttctgatgcagcacattttaagatttgcctttaaagctttgagccttgagattaggttagttaggaagaggacaacaaagggaagagattattctaataaaacttccacagagggaagaaaattgaggagcttcagatctctaaagccaaattcaacctgatctttctaggttggttataaagctggtccacttccaggaagtgatgtgtaggtgaataggaacaaaaggtgaagaagcagtaaaactgtgaccaagtggccagatggggcttttgccggctgattgaaaggaagtctacagacctaacataagcagtcagccaaaggtggctgtgggaggttgatttcttccagaaacttccaagttgtggctacaaatttattgccagatattttcccactgagaatactgaggttattcacataatcacttccttaacaaaggaagaagcacttttaacttgggctgcattccctttgtgagggtccacatttaggatcctcctgctaccataaggccccttttggggttctttgggtgtggctgcatctcaccatgttgaggattgccttttttttttttttttttttttttttttaacacagagccttgctctgtctcccaggctggagtgcagtggtgcgatcttggctcactgcaacctctgcctcccaggttcaagcaattctcctgcctcagcctcccaagtagccggaattacaggcatgtgccaccatgctgggctaatttttgtatttttagtggagacggtgtttcaccatgttggccaggctgttcttgaactcctggcctcaagtgacccgcccacattggcctcccaaagtgctgggattacaggcgtgagcccccgtgcccagcaaggattgctgttttaattcttgtatcttcgttgcttctttggtctttgcttaaacaaaacaataaagcttaatagttggggagaatgctgttaccagtgtcctctaggaaggctgttagcatatggctctactgagcagcagtgccatctggtgcctgagatcatgtgcttcaggcagttgtcacactgcatctacagccaagcatcacagaaacacttcactcatgtggtcagggaaggtgggactgattcacatgttagagacaggtcagatgggaaaattaaggcccaacttggtgttggggaataaccatactctggtctttcaagtgtagtagctgatgattcccaagaaactgatgaattttctgagtccagacaaaatttccccaagcctgctctctctgttggatatacataatagagaaagtcaaatcagccctttggggtttgtggtaaaaattcactcacccattgaagcctaaggtggctttgtaccttccagatctctcagcaaatcccctgggcagaaatgtcacctgcttgccatgtctttgaggggttcaggtcagcctggagaacaggctccttaggtcaaaaaccttgttttaagagccactgtggtacagtcaatgtaacccacttgtgcagaagccatgcttccaaggaaggtctcaggttgacaactagacatcaaatctgagaagccaactgtggagtaatgtgtttttttctctgtggacaagagtgatcagaaaggtgcttgatcttgaacaattgatccatgatgaaaaaatgaccattagctctcccccagaagcgtctgtgtttgctgaatggagctgagattttgatccgctatcagactccagaaagatccaggagttccaagaacatggcaaagagtcaaaatcttaggacaaggaattaaaatgccagaatgcaaatgtccaacaggcctggtagctcacagctatcaacaccctagaattccacactgcctcactgcagttgctcaaggatgggtatgtttctgtctctgaaattcgggaaaaagccttaagtgccagagaaggtgcttccaagactgtctgcagaattcctttcctagggtctgtctctggtacccaaaagggcagagaaggaaccctaagattagcatagagccactcatctctcctcccctccccaccccttcttcccctgcttccattccccatggctctctcctctgactgtgaaacacttcctctccagcagtgttgggaaagttctggacctctactggatctagccataaatggtggtcttcagaaaaatggagattgtggctgccagcacccacaagacagcagcctcatgccatgcaggcagcaagccatcctgaacagcgttcctcccagagtctgtttcctcacctgctgttcactggtgagaggaaaagggacttgttctcccttgaccagttttctagttttcctgttcccaccctggtctttgcctgatgacagagaaactttctaaaaaaaaacaaaaacaaaagctataaaaaatctgcaaaacacccta

SEQ ID NO: 197610 - DNA, 849 bp, Homo sapiens
  Payload ID: 18968
  Gene Name: ubiquitin-conjugating enzyme E2D 4 (putative)
  ENST ID: ENST00000450743
  CDS Start-End: 96-224
ggctcccggcgtgcagcttggtggcggctgagccggcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagca

SEQ ID NO: 197611 - DNA, 783 bp, Homo sapiens
  Payload ID: 18968
  Gene Name: ubiquitin-conjugating enzyme E2D 4 (putative)
  ENST ID: ENST00000446008
  CDS Start-End: 18-386
cccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaaggtagagatgctgatggcatgctctgtgtgctcttttacacatgtttttaccccagcactgactgagtggaaatggaagctcagagaaagaagtcacctttcccaggtcacatagccctgtccactgctgtgcccttaagtggatatccttacacgcctacgaggcagcaccagcagaactttgtgccccgctccctggcgcttctcagcagtcaattgccctggtgtgctcaagactgtcacatgggtgcaagaagaaaatactgattctacttatatttttttatccaaaaataagaaaggcaaatattacattaccttctctgttccctcatttattcatctaataagcacaaaacggactgtgagtcagccctgaaggaagatacagggcatgcctccgggggcctcgaagttggtggagaaatcctcccttcccaaaataaatgatgttgagcacatg

SEQ ID NO: 197612 - DNA, 789 bp, Homo sapiens
  Payload ID: 18968
  Gene Name: ubiquitin-conjugating enzyme E2D 4 (putative)
  ENST ID: ENST00000454350
  CDS Start-End: 92-211
cccggcgtgcagcttggtggcggctgagccggcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgactgttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacac

SEQ ID NO: 197613 - DNA, 743 bp, Homo sapiens
  Payload ID: 18968
  Gene Name: ubiquitin-conjugating enzyme E2D 4 (putative)
  ENST ID: ENST00000443780
  CDS Start-End: 90-218
cggcgtgcagcttggtggcggctgagccggcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaaggtagagatgctgatggcatgctctgtgtgctcttttacacatgtttttaccccagcactgactgagtggaaatggaagctcagagaaagaagtcacctttcccaggtcacatagccctgtccactgctgtgcccttaagtggatatccttacacgcctacgaggcagcaccagcagaactttgtgccccgctccctggcgcttctcagcagtcaattgccctggtgtgctcaagactgtcacatgggtgcaa

SEQ ID NO: 197614 - DNA, 1040 bp, Homo sapiens
  Payload ID: 18968
  Gene Name: ubiquitin-conjugating enzyme E2D 4 (putative)
  ENST ID: ENST00000440899
  CDS Start-End: 64-192
ccggcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaagagtttcgctcttgttgcccaggatggagtgcaatggcgtgatctcggctcaccgcaacatccacctcccaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacac

SEQ ID NO: 197615 - DNA, 288 bp, Homo sapiens
  Payload ID: 18968
  Gene Name: ubiquitin-conjugating enzyme E2D 4 (putative)
  ENST ID: ENST00000454428
  CDS Start-End: 44-172
gcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgactgttgctttcacaaccaaaatttatcaccctaatatcaacagcaatggcagcatctgcct

SEQ ID NO: 197616 - DNA, 921 bp, Homo sapiens
  Payload ID: 18968
  Gene Name: ubiquitin-conjugating enzyme E2D 4 (putative)
  ENST ID: ENST00000415051
  CDS Start-End: 44-268
gcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggtgaggtccctctcccaactcccctgatgtttggatgaaggacagcatgtgacaaggggcccttcaagtcaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccac

SEQ ID NO: 197617 - DNA, 478 bp, Homo sapiens
  Payload ID: 18968
  Gene Name: ubiquitin-conjugating enzyme E2D 4 (putative)
  ENST ID: ENST00000473007
  CDS Start-End: 1-96
gaattaaccgacttgcagagggatcctcctgcccagtgttctgcaggacctgtcggtgatgactgttgctttcacaaccaaaatttatcaccctaatatcaacagcaatggcagcatctgccttgatatcctgcggtctcagtggtctccagcgttgactgtgtcaaaaggtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctct

SEQ ID NO: 197618 - DNA, 1511 bp, Homo sapiens
  Payload ID: 18969
  Gene Name: ubiquitin-conjugating enzyme E2E 1
  Uniprot ID: P51965
  ENST ID: ENST00000306627
  CDS Start-End: 220-801
ggcggcggcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaaca

SEQ ID NO: 197619 - DNA, 1398 bp, Homo sapiens
  Payload ID: 18969
  Gene Name: ubiquitin-conjugating enzyme E2E 1
  Uniprot ID: P51965
  ENST ID: ENST00000346855
  CDS Start-End: 158-688
taatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaaca

SEQ ID NO: 197620 - DNA, 1166 bp, Homo sapiens
  Payload ID: 18969
  Gene Name: ubiquitin-conjugating enzyme E2E 1
  ENST ID: ENST00000452012
  CDS Start-End: 1-456
agaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggcctcagttttctttctaggacaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaaca

SEQ ID NO: 197621 - DNA, 622 bp, Homo sapiens
  Payload ID: 18969
  Gene Name: ubiquitin-conjugating enzyme E2E 1
  ENST ID: ENST00000442670
  CDS Start-End: 182-622
aatgggcctgcagactttgaaaagcgagtggagggcggtgggcggccgcgtgcgcccctggtcaatgccctcctgacagcacccgagttccttatttacactggctgcatggtttgtgtgtttctgttttgtttctctccccctgcaggggctgtttgcggggtggggtggggggttcgctatgtcggatgacgattcgagggccagcaccagctcctcctcatcttcgtcttccaaccagcaaaccgagaaagaaacaaacacccccaagaagaaggagagtaaagtcagcatgagcaaaaactccaaactcctctccaccagcgccaagagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaa

SEQ ID NO: 197622 - DNA, 1224 bp, Homo sapiens
  Payload ID: 18969
  Gene Name: ubiquitin-conjugating enzyme E2E 1
  Uniprot ID: P51965
  ENST ID: ENST00000424381
  CDS Start-End: 34-516
agtctatccccagtgtgagctagagagcggaccatgaaggaagtgggcagaccccgggaagttagaggacgcccggggaaaagcagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctgccgaccccttggtgggaagtattgccactcagtatatgaccaacagagcagaacatgacagaatggccagacagtggaccaagagatacgctacataaattggggtttcacaattcttacattatttgtctgtcacagaagagagctgcttatgattttgaaggggtcagggagggtgggagttggtaaagagtagggtatttctataacagatattattcagtcttatttcctaagattttgttgtaacttaaggtatcttgctacagtagacagaattggtaatagcaacttttaaaattgtcattagttctgcaatattagctgaaatgtagtacagaaaagaatgtacatttagacatttgggttcagttgcttgtagtctgtaaatttaaaacagcttaatttggtacaggttacacatatggccatttatgtaaagtccctctaagactacatactttttgtttaaaacaaaattggaatttgttttcccttcttggaagggaacattgatatttaacagagtttttagagattgtcatctcatatatataaaatggacacgtggctataaaacaccatataagagatgagtagtgcgttttattttatatgccaatctactttgtttaaaaaaggtctgaatcaggacttgtgaaaacctgtagtgaaataccttaagctgttaactaactgtaaggcgtggaataggagttgctcagtggattggttctatgttgtggactacttaagtctgcatttgttactgtgctaataaacaatattaaaaaccacctaataaa

SEQ ID NO: 197623 - DNA, 585 bp, Homo sapiens
  Payload ID: 18969
  Gene Name: ubiquitin-conjugating enzyme E2E 1
  ENST ID: ENST00000467766
  CDS Start-End: 34-537
agtctatccccagtgtgagctagagagcggaccatgaaggaagtgggcagaccccgggaagttagaggacgcccggggaaaagcagaattcagaaggagctggcggacatcactttagaccctccacctaattgcagtgctggtcccaaaggcgataacatctatgaatggagatcaaccattctagggcctccaggatccgtgtatgagggtggtgtattctttctcgatatcacttttacaccagaatatcccttcaagcctccaaaggttacatttcggacaagaatctatcattgtaatattaacagtcaaggtgttatttgcttggacatattgaaagataattggagtccagcactaaccatttctaaagtcctcctttctatctgctcacttcttacagactgtaatcctggtaaggttcataattctttaccttgttttattcttccttacctgaaaaatacttgtttccaaaagctttcaaaggacaaaactaatttttctgcacaagtttgtgaatacaaaaactaatcggcttttcaaaagaaagttttaatcaagttcagtctactagttgag

SEQ ID NO: 197624 - DNA, 1330 bp, Homo sapiens
  Payload ID: 18970
  Gene Name: ubiquitin-conjugating enzyme E2E 2
  ENST ID: ENST00000335798
  CDS Start-End: 110-388
actttccaggactcaggggcagccacagcgacagccgcgggcagcagcctcaggagccggagctggaacggccgggggcggcggcagcggcggcgctgagggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgc

SEQ ID NO: 197625 - DNA, 2748 bp, Homo sapiens
  Payload ID: 18970
  Gene Name: ubiquitin-conjugating enzyme E2E 2
  Uniprot ID: Q96LR5
  ENST ID: ENST00000396703
  CDS Start-End: 181-786
gacaggcgtggtcgggtgcgtggtgcgtgggtccggctttcggtgactagacggtccgcaggggacatcccgtccctggggcctccccagtctccctccccctcgcgcctgggcagctctctcccagggcttcggctcgagcctgcgacctgcacggacacccccccctcaggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgcacttctggtaacccgacatttgctttgtgtcctggtgaccgctgtagccctacgtgcagtgaggcttgtctaattcaattacaggttcaagtgtatttttcatctcaaacctctaatatttctttggagttgagttgcttagcatgtggaatttctccagctgtcagtagcctgatgattttatggttgttatagtaaattgctatcattttacatattgactgggcattctttctgttacagccttctttatcaacaattaaaatatgtaactccaaaaatagccttcttgtgaaagtgaagtctgagctaatcattgtgttcagccactttcaactttatttctctcaaaattgttacagtgattgccctcaagctttgtattgttcatttttgttgttgttgttgttgttgttgctgctcttttttctccatgattttagcaaaagaagtaaactcaactgtattggtcacggtcagcccattcaatgacaagggtgtctgtctggcttcaccttcaggctattttagtgtgcagctataggaggcagaggaaacgtgggtggtgtagtttctaaaacacgctgacttgctgattgataattcagggttattagtgtaacaaagcgtagtggaaactcctactcctgctgcaccatacagttacagaccctaccatactcttggtctcatttaaggaaccattaacaccttcactgctgaaaagcaggatttataagcataagtcatccacctctaaatattttaacatttaaaatgcctgattcaaaagatacagtttttgttgtttttaactagttaaaaataaatcctaagaaaatatatttaaatattgcaaatgccacttctaaaccaaaatacctgagaatattttttgtctttttaataacgattttaccattcattttatttaaaaacatttctcagcatagcagggcactgtatggtctctgatgcactactcaaccctctagttgtagtagagggagccacagacagtacataaatgcattgggcagagctatattccagtgaaactttatttaccaccataggcatgggatttggcccatgggttgtagtttgccaatccctgacacagaccaacatagactgggggctggatgaaaaacaaataacgatgtgtcatttctttctttaacataaaataaattcaatatggtacaacactg

SEQ ID NO: 197626 - DNA, 665 bp, Homo sapiens
  Payload ID: 18970
  Gene Name: ubiquitin-conjugating enzyme E2E 2
  ENST ID: ENST00000452894
  CDS Start-End: 172-665
gcgcactcgcgggtgcgcgcgcggacggccgggcggcggcggctcccggaggtggtggcttcactttccaggactcaggggcagccacagcgacagccgcgggcagcagcctcaggagccggagctggaacggccgggggcggcggcagcggcggcgctgagggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagcaccaacataacactgaaaggaaatgctcattcaattctcaattggatttttggattttggatgcccactagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctgga

SEQ ID NO: 197627 - DNA, 1248 bp, Homo sapiens
  Payload ID: 18970
  Gene Name: ubiquitin-conjugating enzyme E2E 2
  Uniprot ID: Q96LR5
  ENST ID: ENST00000425792
  CDS Start-End: 252-857
gaggagggaggcgcgcggcgccgcatggccgacgtggggctcgcgctctcgcggtctctcccgggcgggcgcgcaggcacgcgcactcgcgggtgcgcgcgcggacggccgggcggcggcggctcccggaggtggtggcttcactttccaggactcaggggcagccacagcgacagccgcgggcagcagcctcaggagccggagctggaacggccgggggcggcggcagcggcggcgctgagggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtagtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgattttt

SEQ ID NO: 197628 - DNA, 579 bp, Homo sapiens
  Payload ID: 18970
  Gene Name: ubiquitin-conjugating enzyme E2E 2
  ENST ID: ENST00000427371
  CDS Start-End: 144-413
tttcggtgactagacggtccgcaggggacatcccgtccctggggcctccccagtctccctccccctcgcgcctgggcagctctctcccagggcttcggctcgagcctgcgacctgcacggacacccccccctcaggatctaaaatgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtaggctgttcctgattcgatctgcttgcatctcttctaacttgtgagtgacttggaaggagcagacttcatcttacttctattcatttctcaattaactatgactaacatacactaggcacccaaaaagttaagatgatagcagtaatgaagagaaatggaccttgagtttcagaaacttgtattctaatggaccttcaaaagatggcaagt

SEQ ID NO: 197629 - DNA, 282 bp, Homo sapiens
  Payload ID: 18970
  Gene Name: ubiquitin-conjugating enzyme E2E 2
  ENST ID: ENST00000613545
  CDS Start-End: 1-282
agtgctggacccaaaggagacaacatttatgaatggaggtcaactatattgggacccccaggatctgtctatgaaggaggggtgttctttcttgacattaccttttcaccagactatccgtttaaaccccctaaggttaccttccgaacaagaatctatcactgtaatattaacagccaaggtgtgatctgtctggacatcttaaaggacaactggagtccggctttaactatttctaaagttctcctctccatctgctcacttcttacagattgcaaccct

SEQ ID NO: 197630 - DNA, 267 bp, Homo sapiens
  Payload ID: 18970
  Gene Name: ubiquitin-conjugating enzyme E2E 2
  ENST ID: ENST00000628311
  CDS Start-End: 1-267
atgtccactgaggcacaaagagttgatgacagtccaagcactagtggaggaagttccgatggagatcaacgtgaaagtgttcagcaagaaccagaaagagaacaagttcagcccaagaaaaaggagggaaaaatatccagcaaaaccgctgctaaattgtcaactagtgctaaaagaattcagaaggaacttgcagaaatcacattggaccctcctcccaactgtaggctgttcctgattcgatctgcttgcatctcttctaacttg

SEQ ID NO: 197631 - DNA, 1347 bp, Homo sapiens
  Payload ID: 18971
  Gene Name: ubiquitin-conjugating enzyme E2E 3
  Uniprot ID: Q969T4
  ENST ID: ENST00000392415
  CDS Start-End: 188-811
gcaggggccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggc

SEQ ID NO: 197632 - DNA, 1570 bp, Homo sapiens
  Payload ID: 18971
  Gene Name: ubiquitin-conjugating enzyme E2E 3
  Uniprot ID: Q969T4
  ENST ID: ENST00000410062
  CDS Start-End: 394-1017
gaacttgctgactgcgcggccgggaggagccgagccgggcggcggcggcgggaggctacagcgcgcgggggtctcccgcgtcccctccgcctcgccgggagctcgcgccctcgcccagccgagctcccacccccgcttttttccgaaggcgctgggcggcgccaccctccggccggagcccggcactgcacaaccccctccgactttcaatgttccacactccccggccagagcctcctcggcttctttttttccctccccccccttcccccccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaa

SEQ ID NO: 197633 - DNA, 602 bp, Homo sapiens
  Payload ID: 18971
  Gene Name: ubiquitin-conjugating enzyme E2E 3
  ENST ID: ENST00000602475
  CDS Start-End: 193-528
gactttcaatgttccacactccccggccagagcctcctcggcttctttttttccctccccccccttcccccccccacagctgcctccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcaggaaaatcagcaagtcttgcatagagtgtaaggacattcagattgagaatgaagaacttgtcctttcagtctcttcttccctatcaatatgagataaaaacataataaaatcacttgtaaatctagagaaatagaaagtgatttttttttccacataccaattttg

SEQ ID NO: 197634 - DNA, 752 bp, Homo sapiens
  Payload ID: 18971
  Gene Name: ubiquitin-conjugating enzyme E2E 3
  ENST ID: ENST00000602479
  CDS Start-End: 229-752
ccaagggcggcaggggccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccc

SEQ ID NO: 197635 - DNA, 744 bp, Homo sapiens
  Payload ID: 18971
  Gene Name: ubiquitin-conjugating enzyme E2E 3
  ENST ID: ENST00000602499
  CDS Start-End: 376-744
gggggcgggggcgggcagctttgttcgcgccgggcgcccgcgtcgccggtgtccgcgagccgcggcggggccggctgggctgctcgcatcacttggcgcccggcgcggcgagcgctacccgcggcccccgcgcggccctccccacaaagggccgcggagctgcgtggccgccgccgccggccgtggctcgcctccgcgggcgcggaaatttgttgcacttcttggggctttgtttatttgtttgttttttctctgggtttcttatttttttcgttattttggacaaaatgtcggtccgtgatataaaaattgagcgaggaaccttggtggcattgggagctttgcagaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaag

SEQ ID NO: 197636 - DNA, 654 bp, Homo sapiens
  Payload ID: 18971
  Gene Name: ubiquitin-conjugating enzyme E2E 3
  ENST ID: ENST00000602303
  CDS Start-End: 129-654
caatatgaagagctacggccaagttcatgcagtcacaggcaatgacaactatatcaccaatgctgcctggctgagagtgatttaagacatcattgattggaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctg

SEQ ID NO: 197637 - DNA, 766 bp, Homo sapiens
  Payload ID: 18971
  Gene Name: ubiquitin-conjugating enzyme E2E 3
  ENST ID: ENST00000602291
  CDS Start-End: 182-705
gccagcccgccgggtccccgccgcgctctttgtcctggccgcgcgcgggcggacgcgtgcacccccagggtgaggggaggtgtggagagcgcgcacgggagcgcgcgggaacagctcgcgcccgccgggcgtcggcggcgcgcgcccctccgccagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgac

SEQ ID NO: 197638 - DNA, 1556 bp, Homo sapiens
  Payload ID: 18971
  Gene Name: ubiquitin-conjugating enzyme E2E 3
  Uniprot ID: Q969T4
  ENST ID: ENST00000602710
  CDS Start-End: 380-1003
tcacttggcgcccggcgcggcgagcgctacccgcggcccccgcgcggccctccccacaaagggccgcggagctgcgtggccgccgccgccggccgtggctcgcctccgcgggcgcggaaatttgttgcacttcttggggctttgtttatttgtttgttttttctctgggtttcttatttttttcgttattttggacaaaatgtcggtccgtgatataaaaattgagcgaggaaccttggtggcattgggagctttgcagaaggtgcagtttgaattctgcttttcccagggtggcagctcggtcttggccggatgaatcttcgctgctggccgtggaaacagctagagcagctcttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggcatagtttcctgtcgtaa

SEQ ID NO: 197639 - DNA, 909 bp, Homo sapiens
  Payload ID: 18971
  Gene Name: ubiquitin-conjugating enzyme E2E 3
  Uniprot ID: Q969T4
  ENST ID: ENST00000602959
  CDS Start-End: 145-768
cggccaagggcggcaggggccagcccgccgggtccccgccgcgctctttgtcctggccgcgcgcgggcggacgcgtgcacccccaggcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggaga

SEQ ID NO: 197640 - DNA, 446 bp, Homo sapiens
  Payload ID: 18971
  Gene Name: ubiquitin-conjugating enzyme E2E 3
  ENST ID: ENST00000602632
  CDS Start-End: 21-413
caagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagagggtgtccttgtcctctcctagtcaccacttgtgcaaacagcgaaagtttagaaaggaaaatcagcaagtcttgcatagagtgtaaggacattcagattgagaatgaagaacttgtcctttcagtctcttcttccctatcaatatgagataaaaacataataaaatcacttgtaaatcta

SEQ ID NO: 197641 - DNA, 2009 bp, Homo sapiens
  Payload ID: 18972
  Gene Name: ubiquitin-conjugating enzyme E2F (putative)
  Uniprot ID: Q969M7
  ENST ID: ENST00000272930
  CDS Start-End: 195-752
aaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttca

SEQ ID NO: 197642 - DNA, 924 bp, Homo sapiens
  Payload ID: 18972
  Gene Name: ubiquitin-conjugating enzyme E2F (putative)
  Uniprot ID: Q969M7
  ENST ID: ENST00000409953
  CDS Start-End: 7-492
ccgggcatggtgttgggcgccgggcccgcctcgcctgtctcggggagcccagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactg

SEQ ID NO: 197643 - DNA, 1138 bp, Homo sapiens
  Payload ID: 18972
  Gene Name: ubiquitin-conjugating enzyme E2F (putative)
  ENST ID: ENST00000409332
  CDS Start-End: 68-559
cgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacaga

SEQ ID NO: 197644 - DNA, 837 bp, Homo sapiens
  Payload ID: 18972
  Gene Name: ubiquitin-conjugating enzyme E2F (putative)
  Uniprot ID: Q969M7
  ENST ID: ENST00000409633
  CDS Start-End: 136-630
acttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgt

SEQ ID NO: 197645 - DNA, 760 bp, Homo sapiens
  Payload ID: 18972
  Gene Name: ubiquitin-conjugating enzyme E2F (putative)
  ENST ID: ENST00000455999
  CDS Start-End: 132-437
ccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaa

SEQ ID NO: 197646 - DNA, 552 bp, Homo sapiens
  Payload ID: 18972
  Gene Name: ubiquitin-conjugating enzyme E2F (putative)
  ENST ID: ENST00000416292
  CDS Start-End: 136-552
acttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggac

SEQ ID NO: 197647 - DNA, 803 bp, Homo sapiens
  Payload ID: 18972
  Gene Name: ubiquitin-conjugating enzyme E2F (putative)
  Uniprot ID: Q969M7
  ENST ID: ENST00000433241
  CDS Start-End: 70-432
accgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgaggatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtac

SEQ ID NO: 197648 - DNA, 561 bp, Homo sapiens
  Payload ID: 18972
  Gene Name: ubiquitin-conjugating enzyme E2F (putative)
  ENST ID: ENST00000448502
  CDS Start-End: 136-561
acttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccaggatttttttgttttgttttgtgttttttgatagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggct

SEQ ID NO: 197649 - DNA, 831 bp, Homo sapiens
  Payload ID: 18972
  Gene Name: ubiquitin-conjugating enzyme E2F (putative)
  ENST ID: ENST00000445676
  CDS Start-End: 60-296
cgccgggagccggtgcggctgtgaggggccgcgtctcgcagcagccgcccggaccgggcatggtgttgggcgccgggcccgcctcgcctgtctcggggagcccagaggttgcagaacttgaagctaatttaccttgtacatgtaaagtgcattttcctgatccaaacaagcttcattgttttcagctaacagtaaccccagcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaat

SEQ ID NO: 197650 - DNA, 571 bp, Homo sapiens
  Payload ID: 18972
  Gene Name: ubiquitin-conjugating enzyme E2F (putative)
  ENST ID: ENST00000439780
  CDS Start-End: 90-461
gtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgaggatgtcgtttggggattaaactctttgtttactgatcttttgaattttgatgatccactgaatattgaagctgcagaacatcatttgcgggacaaggaggacttccggaataaagtggatgactacatc

SEQ ID NO: 197651 - DNA, 2100 bp, Homo sapiens
  Payload ID: 18972
  Gene Name: ubiquitin-conjugating enzyme E2F (putative)
  Uniprot ID: Q969M7
  ENST ID: ENST00000414443
  CDS Start-End: 195-656
aaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttcatttgctgcctgcctaacactctcaaacttaactgccagcttccttagacctctggattcccccatctgccatctactgggtttagtttgtttttcttaatttatagaatctctgattgtgagatcagtctgtcacggagacccagcaggtgaggaatgtaggccttgcttcctctttgcacccatta

SEQ ID NO: 197652 - DNA, 648 bp, Homo sapiens
  Payload ID: 18972
  Gene Name: ubiquitin-conjugating enzyme E2F (putative)
  ENST ID: ENST00000434655
  CDS Start-End: 134-648
gttaccgaaatgctgccttagagcgtaatttgcaggaaagaggaagttttgttttaaaccagatcttcaagagttgaagcatattgaagaaggaaaagaattctgaagcaactgcagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggactt

SEQ ID NO: 197653 - DNA, 1292 bp, Homo sapiens
  Payload ID: 18972
  Gene Name: ubiquitin-conjugating enzyme E2F (putative)
  ENST ID: ENST00000454786
  CDS Start-End: 75-218
cccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaaggtcaaagcctacggcgaatcttgtgaaaaattagttctcttcacggaattaataacatatagtgttctagagttttcgtgacttctgctatccatgttgaggttgcagaacttgaagctaatttaccttgtacatgtaaagtgcattttcctgatccaaacaagcttcattgttttcagctaacagtaaccccagaatttggctggtgtgatgcttctttgcttactgtgcctactgagtaggccaccccatcatctgatacagagacacctgatctgttctcacattggtctgtcccctgccttaaatgtaactccaagtcagattctctcgtgggatgctcaggcttcctgaaatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgc

SEQ ID NO: 197654 - DNA, 984 bp, Homo sapiens
  Payload ID: 18972
  Gene Name: ubiquitin-conjugating enzyme E2F (putative)
  ENST ID: ENST00000417231
  CDS Start-End: 124-267
gccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaaggtcaaagcctacggcgaatcttgtgaaaaattagttctcttcacggaattaataacatatagtgttctagagttttcgtgacttctgctatccatgttgaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaa

SEQ ID NO: 197655 - DNA, 1242 bp, Homo sapiens
  Payload ID: 18972
  Gene Name: ubiquitin-conjugating enzyme E2F (putative)
  Uniprot ID: Q969M7
  ENST ID: ENST00000441728
  CDS Start-End: 205-513
ttttttttttaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtat

SEQ ID NO: 197656 - DNA, 873 bp, Homo sapiens
  Payload ID: 18972
  Gene Name: ubiquitin-conjugating enzyme E2F (putative)
  ENST ID: ENST00000439338
  CDS Start-End: 110-301
gtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttacagggtctctctttgttgcccaagttggagtacagtggcatgagtgtggctcactgcagtctcaacctcctgggctcaagtgatcttcccacctcagtctcctgagcagctgagacctcagacctcaggtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctc

SEQ ID NO: 197657 - DNA, 574 bp, Homo sapiens
  Payload ID: 18972
  Gene Name: ubiquitin-conjugating enzyme E2F (putative)
  ENST ID: ENST00000433568
  CDS Start-End: 136-396
acttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagaatttggctggtgtgatgcttctttgcttactgtgcctactgagtaggccaccccatcatctgatacagagacacctgatctgttctcacattggtctgtcccctgccttaaatgtaactccaagtcagattctctcgtgggatgctcaggcttcctgaaatgagggttactaccagggtggaaaatttcagtttgaaactgaagttcccgatgcgtacaacatg

SEQ ID NO: 197658 - DNA, 830 bp, Homo sapiens
  Payload ID: 18972
  Gene Name: ubiquitin-conjugating enzyme E2F (putative)
  ENST ID: ENST00000440223
  CDS Start-End: 323-469
tggccgcgccctctgccaatgagcgaggtccgagaggcccgtcgcccagcccagtcccgatcggcgcacgccgctgttcgcgtgtctggttccaaataaagtttttcgcgactttgaattttttttttaaagcgcccgctgctgtctcggctgccgcgggcgagagcggccgagtccccgccccgccacttccggtcccgccgccgggagccggtgcggctgtgaggggccgcgtctcgcagcagccgcccggaccgggcatggtgttgggcgccgggcccgcctcgcctgtctcggggagcccagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagacggggtctcactctgtcacgtagagtgagtggtgtagagcgcagtggtgtggtcccggcttactgcagcctcgacttcccaggctcaggtgatcctcccacttcaatatcttgagcagttgggactacagaggttgcagaacttgaagctaatttaccttgtacatgtaaagtgcattttcctgatccaaacaagcttcattgttttcagctaacagtaaccccagcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactg

SEQ ID NO: 197659 - DNA, 472 bp, Homo sapiens
  Payload ID: 18972
  Gene Name: ubiquitin-conjugating enzyme E2F (putative)
  ENST ID: ENST00000434137
  CDS Start-End: 14-472
aaaggcagcagtaatgctaacgctagcaagtaaactgaagcgtgacgatggtctcaaagggtcccggacggcagccacagcgtccgactcgactcggagggtttctgtgagagacaaattgcttgttaaaggtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaa

SEQ ID NO: 197660 - DNA, 2135 bp, Homo sapiens
  Payload ID: 18972
  Gene Name: ubiquitin-conjugating enzyme E2F (putative)
  Uniprot ID: Q969M7
  ENST ID: ENST00000612130
  CDS Start-End: 134-691
gttaccgaaatgctgccttagagcgtaatttgcaggaaagaggaagttttgttttaaaccagatcttcaagagttgaagcatattgaagaaggaaaagaattctgaagcaactgcagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttgtacatgtaaagtgcattttcctgatccaaacaagcttcattgttttcagctaacagtaaccccagatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttcatttgctgcctgcctaacactctcaaacttaactgccagcttccttagacctctggattcccccatctgccatctactgggtttagtttgtttttcttaatttatagaatctctgattgtgagatcagtctgtcacggagacccagcaggtgaggaatgtaggccttgcttcctctttgcacccatta

SEQ ID NO: 197661 - DNA, 3974 bp, Homo sapiens
  Payload ID: 18973
  Gene Name: ubiquitin-conjugating enzyme E2G 1
  Uniprot ID: P62253
  ENST ID: ENST00000396981
  CDS Start-End: 167-679
accggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcgtgcatctctgctctgtggggtttggagaaatgctttggcagaagagtgaaagaactcctgccaagagcccagacctctacaaacgttgtatgtccttttttaagcagaaataaaatggttgaggatgtagtcacagtagagagtgatttttttctaagtccctgtcctctactctgaagcgttataaaaacctgtaaacattatacaaacccacaaaccttatagaaactcgtaagtgtgttgtgactggaaattgattcattagaacccagttttctttaagaactttgtgacttggttttttttttccttttccaaagactgtaaaaatagttgccccaaaatgtcagcactgcacaccctccagggacttggaatacaatcctttttacttttttttttttttttttaagaaactgggtctctctgtcacccaggctggagtgcagtggcaacgatcatagctaactgcagctttgacctcctgggctcaagtgatcctcctgcctcagcctcctgagtagctaggactacaggtgtatgccaccatgcctggctaatacaaaaaaattcttttaagagatgggatccctcccttttaaaatcagaacttgttcacatggtggttgcttgtggcaaaacggagttcaaattttgctctcctattgctataattctgctagcaatctgttgaggtgaaacttgggatctgactcttcagcaagcagcaaatgacctagtaactcagggacaactatttttgaactttaagtgccactttaatgcagttagtttgataaaaccatgtgggttttttttttagggctagctctacgggagtggaagtgagagccaggcatgagtgcgtctccacatgcttttccacctgccctgagtgtgttacatactgaaacaggcctacatagatgttacaacttcccttcctctgtcggagatgtcatctgtgcctttctcagtgttcatctgataatgtaaatttaaatgcctctacatttgatacgaaacccacattcaggtgacactgaacgaggtggcttttgtcccaccagtgcctcatcagtgtgaggcgattcctctctgctttaggaaaatgatttttccccctaaacttgtgccaaccatcaacaacatctccatagatcttatggattgtagaactgttggctgtttcctaaatttattccaagttctcgtagaggcatatagatttcagtctgtgcttgtatgggatagatgatctgagtggctttctggcctcttttttgagtttaaaatccatatgaggttgacgtgtcatactaaggtaacatgtttgtgaggttattccactagtactgtgatcacgtgggtgtcagtatctttaacggccttcattcttggttgtgagattttatttgatatgcccactcaccctcgacgaatctgcccgctttgggctgtggtgcctgtgtatctttgcccgtctggtctccagttggtggaattaccttttttgtactgccacttctcagcatctttgaaatttgacataatgttgcttcatttcagtttttttagttctgtaatttgttgattgtatttaactatgtgagttctgttgtgatgtttactgtattgtaaagcacctcattcatgtgatgagtgctctataaatcaataaatgatgacttagaggctgta

SEQ ID NO: 197662 - DNA, 863 bp, Homo sapiens
  Payload ID: 18973
  Gene Name: ubiquitin-conjugating enzyme E2G 1
  ENST ID: ENST00000574633
  CDS Start-End: 310-459
gggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttaaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacac

SEQ ID NO: 197663 - DNA, 569 bp, Homo sapiens
  Payload ID: 18973
  Gene Name: ubiquitin-conjugating enzyme E2G 1
  ENST ID: ENST00000574059
  CDS Start-End: 552-569
aagatcaacaagagaccttcccttgtaagatgagaattgtgtagtaggtgactattagaagagtaaacaagtcttaagtctgtaaacattttttcagtaaatgcaatggagtaccagatatctctcgttactatgactaaagaaagttcaatggtgacctacttctgcctgagtattgctagaattctttctttatccttgaagttcagtaacttcatcaggatataactcggtcttggtgtgattctcttacattttcctgttaaatgatgttttcagtcccacttctcactactgatctccctcgtacgacggtcactgaactggcgcctctctggggttctgcccagaagattagccttcctccttcgctgcagctcctctaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaa

SEQ ID NO: 197664 - DNA, 1514 bp, Homo sapiens
  Payload ID: 18973
  Gene Name: ubiquitin-conjugating enzyme E2G 1
  ENST ID: ENST00000572484
  CDS Start-End: 641-940
ggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagatgttttcagtcccacttctcactactgatctccctcgtacgacggtcactgaactggcgcctctctggggttctgcccagaagattagccttcctccttcgctgcagctcctctaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacctgtacatagcacaacatgatccggataatatatatactgttcatgtacatccacaaatacaccttgtaccaaataatgctttcttgtagtagaataagaatcgtgtaaattctaagagattttagcaggttttctttcctattcattgtttcttatcagtttaaaaggattcctttaagcatgtcagatgaaaagcaattaggattaaaagtttccatttaatttcccttaaacccttgaggcttcattaaactcttttcacttactaaacttttgtatcttctttgttttgacacactcccctttgcttttatctct

SEQ ID NO: 197665 - DNA, 984 bp, Homo sapiens
  Payload ID: 18973
  Gene Name: ubiquitin-conjugating enzyme E2G 1
  ENST ID: ENST00000571980
  CDS Start-End: 313-465
ggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcagaactcaacaaaaatccagtggaaggcttttctgcaggtttaatagatgacaatgatctctaccgatgggaagtccttattattggccctccagatacactttattgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaatggagaatttaaaagaaaagttgcccgctgtgtaagaaaaagccaagagactgcttttgagtgacatttatttagcagctagtaacttcacttatttcagggtctccaattgagaaacatggcactgtttttcctgcactctacccacctattgctggacttctgttgtacaagttggcaaacactggctggaactgggctgcaataaaacatgccagttatcaatgctgacaagagcctaacaagtgccaacttacagatgattacgcattttgaattctaatgaactgttttaaccttcaggaagaattgtaaagacct

SEQ ID NO: 197666 - DNA, 553 bp, Homo sapiens
  Payload ID: 18973
  Gene Name: ubiquitin-conjugating enzyme E2G 1
  ENST ID: ENST00000571953
  CDS Start-End: 318-553
tttagacattctctgttgacttcttgctatgacagatgttttcagtcccacttctcactactgatctccctcgtacgacggtcactgaactggcgcctctctggggttctgcccagaagattagccttcctccttcgctgcagctcctctaactcaacaaaaatccagtggaaggcttttctgcaggtttaatagatgacaatgatctctaccgatgggaagtccttattattggccctccagatacactttatgaaggtggtgtttttaaggctcatcttactttcccaaaagattatcccctccgacctcctaaaatgaaattcattacagaaatctggcacccaaatgttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcgaaagaatggagggaagatagaaa

SEQ ID NO: 197667 - DNA, 721 bp, Homo sapiens
  Payload ID: 18974
  Gene Name: ubiquitin-conjugating enzyme E2G 2
  Uniprot ID: P60604
  ENST ID: ENST00000330942
  CDS Start-End: 226-639
tcgctcggcgcagctgttgcggggccatggcggggaccgcgctcaagaggctgatggccgagtacaaacccttgagaacgtgcagtgagagcttgaggaagaaggcctgacttgctgctgcggaattaggagggaaaagtgtatgcgttaaaaggggaaaggctcgttggtggagctttgaaagaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctg

SEQ ID NO: 197668 - DNA, 3566 bp, Homo sapiens
  Payload ID: 18974
  Gene Name: ubiquitin-conjugating enzyme E2G 2
  Uniprot ID: P60604
  ENST ID: ENST00000345496
  CDS Start-End: 272-769
acaagaccaggaccctgaggcctctggaagtgccgggaccgaaccaaccccgcagagcgactaaggcgagggcaggagccaagagaatcgtagccgcggtcgcgggttgagctcccaccacccggacagcgcgcctcggcgatcgcgcacgcgccacgccccggaagagttcctgggcccgcgacggtggcccggaagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctgtgctggtaccaaacaaggcagacttgcaagaaccatggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgcagtgtgtgtccctttgtcgtattgtcagaggagcctgtggccactgcccccagggagcacaccagatcatcccagctgggattcctcacggtgggggcttttctgcagacttgggttagctctggcatgttttcttctgtttctgatctcccttctgtcattctgtggtcttcctctggaattctcaggttagttggggtctgtgagacggatgtgttcactaacctataaatgacattttgcagctttttcagcagatgccattgtgtgagtggcacatttgaccactagaagccagcaggctgttccgactgcgcttccctcctgcagttgcttagaagcacagctccctgtcatcactcctctgtggtcctctgtggtcacggttggttgcgatgagacctgcctctgcgtcttgttacttagcatgtcaataaagaggcagattcctgtgtcagtga

SEQ ID NO: 197669 - DNA, 744 bp, Homo sapiens
  Payload ID: 18974
  Gene Name: ubiquitin-conjugating enzyme E2G 2
  ENST ID: ENST00000491513
  CDS Start-End: 76-222
agcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatatcagccctgctagggccatgagccgtgctggcatctgctgttgctgccgacagccctgagtgccgcctccaggggcccagaagacacctgctttgagtttggtgtttttcctgccatcctgagtttcccacttgattacccgttaagtcccccaaagatgagatttacctgtgagatgtttcatcccaacatctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcgcacacaccgccaagcagctcagcattctcccccggcacacttagtgacagtgatgctctgtgctggtaccaaacaa

SEQ ID NO: 197670 - DNA, 637 bp, Homo sapiens
  Payload ID: 18974
  Gene Name: ubiquitin-conjugating enzyme E2G 2
  ENST ID: ENST00000478200
  CDS Start-End: 79-378
ggaagcagtccccggtgtcggggcaggaggcacgcgcgcggctgaggcgaggtcgctcggcgcagctgttgcggggccatggcggggaccgcgctcaagaggctgatggccgagtacaaacaattaacactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaagtcccccaaagatgagatttacctgtgagatgtttcatcccaacagtggacagcctgatgtccagggcaagtatgcatctagtttcttccactctccttgaatgagaagttgtggttcagttcctggatagtagagcgttcaccactgaacgttcaccactgaaacaatggatgagtggaaacacataggaccaggtatgaaagacaagactgtttgaagtctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggca

SEQ ID NO: 197671 - DNA, 5151 bp, Homo sapiens
  Payload ID: 18975
  Gene Name: ubiquitin-conjugating enzyme E2H
  Uniprot ID: P62256
  ENST ID: ENST00000355621
  CDS Start-End: 395-946
ggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagtgtgtgtatgtgtgcacatgtgtgagagtgtgagcgagagtgtgtgtgtgtccatctaagtgtgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttggcaaa

SEQ ID NO: 197672 - DNA, 561 bp, Homo sapiens
  Payload ID: 18975
  Gene Name: ubiquitin-conjugating enzyme E2H
  ENST ID: ENST00000496698
  CDS Start-End: 113-561
gttgcagggttttgtttatataactcaagttgtttggctaaattcttcagcatcgagagtaaacatgaggttacgatcctgggaggacttaatgaatttgtagtgaagttttatggaccacaaggaagtaagtacatgtgttgcaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagtt

SEQ ID NO: 197673 - DNA, 436 bp, Homo sapiens
  Payload ID: 18975
  Gene Name: ubiquitin-conjugating enzyme E2H
  ENST ID: ENST00000480245
  CDS Start-End: 1-189
aggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctatagaattataaattacctaattcccttctgctaaaagacgcaggacagagaagggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaat

SEQ ID NO: 197674 - DNA, 535 bp, Homo sapiens
  Payload ID: 18975
  Gene Name: ubiquitin-conjugating enzyme E2H
  Uniprot ID: P62256
  ENST ID: ENST00000473814
  CDS Start-End: 77-535
ccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctatagatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtag

SEQ ID NO: 197675 - DNA, 758 bp, Homo sapiens
  Payload ID: 18975
  Gene Name: ubiquitin-conjugating enzyme E2H
  ENST ID: ENST00000472396
  CDS Start-End: 389-758
gggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcctctcaatggtgacgctgcagccatgtacctccaccgaccagaagaatacaagcagaaaattaaaggta

SEQ ID NO: 197676 - DNA, 572 bp, Homo sapiens
  Payload ID: 18975
  Gene Name: ubiquitin-conjugating enzyme E2H
  ENST ID: ENST00000490974
  CDS Start-End: 264-572
ggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagcttggcccctgctgaaggctagagctgcttgttttggaaaagcgtatgcaggcaaaaggccgcaggcaccgctcctcagcgctcattggccgccctgttactacccggaaaaggaggaggggaggagctaccaaacagctgatggacatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgt

SEQ ID NO: 197677 - DNA, 2832 bp, Homo sapiens
  Payload ID: 18976
  Gene Name: ubiquitin-conjugating enzyme E2I
  Uniprot ID: P63279
  ENST ID: ENST00000325437
  CDS Start-End: 131-607
aactcgcgggagcgtcaccgtcctgcgacgcttcagaggatccttaggcctcagtggtctttgacccccggccccaggacctgaccccaaggaaacctccgggacctgtggctggagagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagac

SEQ ID NO: 197678 - DNA, 3253 bp, Homo sapiens
  Payload ID: 18976
  Gene Name: ubiquitin-conjugating enzyme E2I
  Uniprot ID: P63279
  ENST ID: ENST00000355803
  CDS Start-End: 552-1028
gacccggtcctgcttgttgcgtgggcgggaggggggaccggaagcgcccctcccccacgggctcgccccgcccccgccgctcgcggtcccccacgtcccgcccgcgccccggcccagggccagcccccggtttagggagcatccacacttctcctcccgtcggtcatgctcgcattcggccttttgtacggggtcagctcattgggcggatgagaaggtgtccccgcctaccgccccgaactggccaattgcaaggggtttcacagggcgctgaactcgcgggagcgtcaccgtcctgcgacgcttcagaggatccttaggcctcagtggtctttgacccccggccccaggacctgaccccaaggaaacctccgggacctgtggctggagaggtgaccgccaggcatccggggagcctttggagatctcggcttcctttttcccccgctgcttgccggcgtgtcctcgggtggacgcgggcagcccgaaggggagtttacagacgctccctcacatcggggacgcggctcctttaagggcggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagac

SEQ ID NO: 197679 - DNA, 2976 bp, Homo sapiens
  Payload ID: 18976
  Gene Name: ubiquitin-conjugating enzyme E2I
  Uniprot ID: P63279
  ENST ID: ENST00000397514
  CDS Start-End: 276-752
gcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacaga

SEQ ID NO: 197680 - DNA, 3109 bp, Homo sapiens
  Payload ID: 18976
  Gene Name: ubiquitin-conjugating enzyme E2I
  Uniprot ID: P63279
  ENST ID: ENST00000397515
  CDS Start-End: 408-884
cagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagac

SEQ ID NO: 197681 - DNA, 1708 bp, Homo sapiens
  Payload ID: 18976
  Gene Name: ubiquitin-conjugating enzyme E2I
  ENST ID: ENST00000402301
  CDS Start-End: 37-591
ccgtgctctgcctcctgtgttccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactggttagtagcagccctggccccgctggtggcagctcctccccgtcccagccaaggccgcctggcaggacgggagtggaggacacaggctcaccctacggacagccagggtccacgcctctgtggggaaggtcggggggcataaaccctgtgggcagcaggcaccgttgcacaccgtctgcggtgggcatggatggcgccggagccgtgtcccggggagggagcaggccaggtgacgggctgtcttgggccactgccccagtgagttgtggccagctaggaggggaaggaccctgggcgtgggtgccagaggaggccatgctgagaggcctctccaccggctcagcctcccatggaccccagcctcccgcgccgcccttgctgcttgtccccatcccctctacaacttggttccttctgtgggggggcccagcccagcagggctcagtgacgtgatgctgtcacacggaccctgggcttccaccctgtccctgtgaggtgctgctgtggctagaagggtccccgtgggcctggggtcctgtctgcaccgaggagggcctggtgtgagttaggatgcagacgacagccaaacagtgctggggaaagcagggaggaccctgccctgagcagaggccatgcgcccgcctgtcctgttccctctgcagctgttctgggcaggtccataagaaggtgggttggggcctccgaccccccactgctccgcctgcagcgttgagaaacccagccccatctcaccacgggtccccacacctctgagggggtctcagggcccccaatggccagggacccagaaggctcacctgcagccaccccacacatccctgccactgtgggcatcagaggccctctccctccagggtgcatctcctggtcaggaggggggaggctgaggggtcccggttgccttaggcccggcctgcacaggtcgtgaggaaaagcacctggtttcggccgggcgcagtggctcacgcttgtaatcccagcactttgggaggccgaggtgggtgaatcatgcggtcaggagttcgagaccagcctggccaacatggcgaaaccctcgtccctactaaaaatacaaaaaattagttgggcgtagtggtgggtgcctctaatcccagctacctgggaggctgagacaggagaatcacttgaacccgggaggcggaagttgcagtgagccgagatcctgccactgctctccagcctggcgacggaggaatgctgtctcaaaaaaaaaaaaa

SEQ ID NO: 197682 - DNA, 1842 bp, Homo sapiens
  Payload ID: 18976
  Gene Name: ubiquitin-conjugating enzyme E2I
  Uniprot ID: P63279
  ENST ID: ENST00000406620
  CDS Start-End: 809-1285
gggaagcgagagctgtgagtcctcaagtcgcagctgggctgctccacgtgggagtggagggtggaggaacgtgtggagtttcggagtccagcccagtgcggagacagccttgaaaccgtggttggcgggcgctccactccgctctgggctcgaaccctgcctgaccatagctgtgccccccactttctccctgtctggcccctggctccccccccctcacttagaggagggcacggggaagggcaaacggtccagagggcgggcggcctgcgggctcctctgcatcatgtgaggagggcgtggggaaggacatcccggtggggcccggtctggggctgcctccagcccgggctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaa

SEQ ID NO: 197683 - DNA, 1217 bp, Homo sapiens
  Payload ID: 18976
  Gene Name: ubiquitin-conjugating enzyme E2I
  Uniprot ID: P63279
  ENST ID: ENST00000403747
  CDS Start-End: 320-796
ggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctaga

SEQ ID NO: 197684 - DNA, 396 bp, Homo sapiens
  Payload ID: 18976
  Gene Name: ubiquitin-conjugating enzyme E2I
  ENST ID: ENST00000566775
  CDS Start-End: 1-211
cctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaataaataacacagggtcctaaaagcccgtatatcctggaagcagagggtctgcgtcggaacagccgactctggaagggcgttggctatgtccctggacgtctcctgcagctcctcccatctcccctgagtctggcccagctggaaaggatgtgggggccacaggtaaattcgaaccaccattatttcac

SEQ ID NO: 197685 - DNA, 884 bp, Homo sapiens
  Payload ID: 18976
  Gene Name: ubiquitin-conjugating enzyme E2I
  ENST ID: ENST00000567074
  CDS Start-End: 472-884
ctcagttctgagcgcctgatactaaggcagggacccagcaccccacatccatctggggccccagccctgcctagtccccacctgatggtatggtgaggaccctgccatgtcagccaccacagggtggcagctaccccccagccgcagcggcccagcctctgaacatctgtctcctcaccttcgagcagaggccgcagcatgtgtcgcagaccagggctgggttggggccatggggaggggtcctacctgcccccgcctcccggtgatctgggcgccgctcacaaggcctcccctggtagacccccggggtcggacgacggcttgcaagaagagagtccctgctgggccaggccaccgtatgttaggagcaagcctgcctgctgcgggccacgtgcgcgtgctggggtggcaggagcccgctcgcctctcctgaccccgtgctctgcctcctgtgttccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactg

SEQ ID NO: 197686 - DNA, 538 bp, Homo sapiens
  Payload ID: 18976
  Gene Name: ubiquitin-conjugating enzyme E2I
  ENST ID: ENST00000567383
  CDS Start-End: 451-538
ggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgagggactttgaacatgtcggggatcgccctcagcagactcgcccaggagaggaaagcatggaggaaagaccacccatttggtttcgtggctgtcccaacaa

SEQ ID NO: 197687 - DNA, 1098 bp, Homo sapiens
  Payload ID: 18976
  Gene Name: ubiquitin-conjugating enzyme E2I
  Uniprot ID: P63279
  ENST ID: ENST00000566587
  CDS Start-End: 463-939
cgcggggcgggggtcgggccgaggcctctactcctgttgggcccgggcccccgactgccccgcgccccgccccgccgagccgggccccgcgccgcggccgagctttccggggagcccgagaggccccgcgctcggcgccggctcggtccgcgctgctggcgccgctgggctgcggcccgagcggccgggccgccgcaggccttcggggccggggctcccccacttcgcccccgaggtgcgcctggcgcggggccggggcagccacctgcagccggggccccgcgaggccgcgccttcctcctgcgcggggagcggcttccggggtcacggtcgccccgcggacggataggatgggccgcggggggagagtcttggattgcaacatcgctggctcgcgggggtgggggccggcgagcgggcttgttttcggtgccttaaaaccaaaacaagtggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcga

SEQ ID NO: 197688 - DNA, 5245 bp, Homo sapiens
  Payload ID: 18977
  Gene Name: ubiquitin-conjugating enzyme E2K
  Uniprot ID: P61086
  ENST ID: ENST00000261427
  CDS Start-End: 285-887
acgcgagctcgtggctcgggcgtatgggggctccaacgggagcggctgcgccgcccggccgggtcaacgtcgtgcgcatgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatggcagttagtggacccaaataagtattcagtggtatataaatatttgaggaactaggtactgaattaggtgctctgagttggcaccccgaaatgtttggaatcacgactatgatttacttaaacacgtaacacattcaaggatatataaatggagtctaagtattttgcttttgaagagaataatctatgaaatggaagacttgattttttttttcattttttagaagtaatacacatttatgattgttggcacataaaactatgcaaaataattctttttaagtatctgtaagaaagaattggcagtttaaacggattttgcttatttatgcactacagaatgcagcatactgtattactgttgaggctgcttaataagtttaccaatgtgaaaagcagatcttgggtataagtgtatgcctgatttgagcttttaaaactgtgcagtaggtgtatggtaatgttttacaatcctatgtagcaaaataggaaattatgaatttttgttgttattgttttaaagatttaagatggattggggtagggaacagctggagccaggtataccttctagtatgtagagggaaacaatgtttagataggaaaaaggaagccgtctgtttacagttaactttatttcatggacttctacaaaatgttgtattaatcactttttctagttcaaggaatttcaattccagggtacaaaccattgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatacaccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaa

SEQ ID NO: 197689 - DNA, 2175 bp, Homo sapiens
  Payload ID: 18977
  Gene Name: ubiquitin-conjugating enzyme E2K
  Uniprot ID: P61086
  ENST ID: ENST00000445950
  CDS Start-End: 153-626
ggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaa

SEQ ID NO: 197690 - DNA, 891 bp, Homo sapiens
  Payload ID: 18977
  Gene Name: ubiquitin-conjugating enzyme E2K
  Uniprot ID: P61086
  ENST ID: ENST00000503368
  CDS Start-End: 166-615
gattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgct

SEQ ID NO: 197691 - DNA, 566 bp, Homo sapiens
  Payload ID: 18977
  Gene Name: ubiquitin-conjugating enzyme E2K
  ENST ID: ENST00000510719
  CDS Start-End: 1-135
atggccaacatcgcggtgcagcgaatcaagcgggagttcaaggaggtgctgaagagcgaggagggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaa

SEQ ID NO: 197692 - DNA, 589 bp, Homo sapiens
  Payload ID: 18977
  Gene Name: ubiquitin-conjugating enzyme E2K
  ENST ID: ENST00000510934
  CDS Start-End: 220-589
aacgtcgtgcgcatgcgccgacccggcgccattttggtggccgggcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtctt

SEQ ID NO: 197693 - DNA, 3028 bp, Homo sapiens
  Payload ID: 18978
  Gene Name: ubiquitin-conjugating enzyme E2L 3
  Uniprot ID: P68036
  ENST ID: ENST00000342192
  CDS Start-End: 199-663
aaacgctgaggcccagtctgtgcggttcacttgcgttcctccacgcgccccccagcacagtgggaagcacacagtaggtgctccgctctgctcctgtgccccgccccgcggcccctcccccgctccaggaagtgcgggggctccagccgcccggccggccgcgatgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 197694 - DNA, 3007 bp, Homo sapiens
  Payload ID: 18978
  Gene Name: ubiquitin-conjugating enzyme E2L 3
  Uniprot ID: P68036
  ENST ID: ENST00000458578
  CDS Start-End: 4-642
agtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 197695 - DNA, 2932 bp, Homo sapiens
  Payload ID: 18978
  Gene Name: ubiquitin-conjugating enzyme E2L 3
  Uniprot ID: P68036
  ENST ID: ENST00000545681
  CDS Start-End: 199-567
aaacgctgaggcccagtctgtgcggttcacttgcgttcctccacgcgccccccagcacagtgggaagcacacagtaggtgctccgctctgctcctgtgccccgccccgcggcccctcccccgctccaggaagtgcgggggctccagccgcccggccggccgcgatgcattctggggaaggagcagcaccaaatccaagatggcggccagcaggaggctgatgaaggacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 197696 - DNA, 1354 bp, Homo sapiens
  Payload ID: 18979
  Gene Name: ubiquitin-conjugating enzyme E2L 6
  Uniprot ID: O14933
  ENST ID: ENST00000287156
  CDS Start-End: 197-658
ttgtccggcgggtcgtccttcgacggcctcctggcctcgccggagcgggtgcggggaggcccacgcagcgacggctggaggaggggtgggcggggctgccgggggtggggtccccggggcggggcggggcgcgctgtgtcgcgggtcggagctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccatttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaa

SEQ ID NO: 197697 - DNA, 1573 bp, Homo sapiens
  Payload ID: 18979
  Gene Name: ubiquitin-conjugating enzyme E2L 6
  Uniprot ID: O14933
  ENST ID: ENST00000340573
  CDS Start-End: 608-871
acaaaggatccccgactgccggggagcggtgctcggagggcacaggtctacgccatcccccacgcagtttcggagatggagcgctgggcccatggagggaaggcggcaggctcggcggctccggcagcttgctggggcaggggctcaaggcggcagtccgatagtggaggccgctgagaactgtcacggagctgcgtctgtacagcgagcatcccttatttattcagggcgagtgtgtatttggggcggcgtgcagggggctgacaaagaccggagagctcccggtgcggccgccggcggagcgaagactggaacccgtatgagcgccccccagcgcccctgagcgctcgccgccggtgcacggcgcaccccgcgggaggcagggatcagcaaagccgtgcgccccgaggcccgcccccgtctccgcacaaagaccgagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccatttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaattctgg

SEQ ID NO: 197698 - DNA, 628 bp, Homo sapiens
  Payload ID: 18979
  Gene Name: ubiquitin-conjugating enzyme E2L 6
  ENST ID: ENST00000526659
  CDS Start-End: 247-628
ctgaaacttgtgataacaactgggtgcatctccagtgcaggaaaagtccttggcatcttggtgccaggcattctgctactgctggtggtgggttatgaacacagatgaccaggatgaagtccttgccttggaataagcccatagcccatcccataatttgatgcctgtattactagagtcctgagaaacacggaatgctgattagaatttgggacaaagttccctgagtattctctggaggaaaagatgcggaggtggacctggaaggcctcctggagtaggtggcttgcgttcgagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccc

SEQ ID NO: 197699 - DNA, 668 bp, Homo sapiens
  Payload ID: 18979
  Gene Name: ubiquitin-conjugating enzyme E2L 6
  ENST ID: ENST00000527022
  CDS Start-End: 472-668
ggtttcaatttcgcttttcctgcctgaaacttgtgataacaactgggtgcatctccagtgcaggaaaagtccttggcatcttggtgccaggcattctgctactgctggtggtgggttatgaacacagatgaccaggatgaagtccttgccttggaataagcccatagcccatcccataatttgatgcctgtattactagagtcctgagaaacacggaatgctgattagaatttgggacaaagttccctgagtattctctggaggaaaagatgcggaggtggacctggaaggcctcctggagagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaa

SEQ ID NO: 197700 - DNA, 1508 bp, Homo sapiens
  Payload ID: 18980
  Gene Name: ubiquitin-conjugating enzyme E2M
  Uniprot ID: P61081
  ENST ID: ENST00000253023
  CDS Start-End: 580-1131
ccgggcgggaagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgca

SEQ ID NO: 197701 - DNA, 734 bp, Homo sapiens
  Payload ID: 18980
  Gene Name: ubiquitin-conjugating enzyme E2M
  ENST ID: ENST00000595957
  CDS Start-End: 526-734
gggaagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgaggcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctc

SEQ ID NO: 197702 - DNA, 349 bp, Homo sapiens
  Payload ID: 18980
  Gene Name: ubiquitin-conjugating enzyme E2M
  ENST ID: ENST00000596985
  CDS Start-End: 1-345
ttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggtgagtaggaataggtggttgggtctggggagattggccttctgtccctctggcctgttgaccccccctacctgtactggccacaggagcccaaccccgaggacccactgaacaa

SEQ ID NO: 197703 - DNA, 5186 bp, Homo sapiens
  Payload ID: 18981
  Gene Name: ubiquitin-conjugating enzyme E2N
  Uniprot ID: P61088
  ENST ID: ENST00000318066
  CDS Start-End: 379-837
ggttaagagagacgcgcgcgcagtcgcgcgcgggtcgtgccgtaccaccgtcgcgggcaggctcggccacgagcgccagagccccgcgcctcccctcgcggcctgtcccaagtccctgccccgcaacagagcgtcacttccgccatccccggcagcggttggggcggggcgcacgggggagggggccaggtcggagggaagcccgcccgtgcccgagcccgcgcccgagcagggactacatttcccgaggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaacaaatgttagcttaattcagaatgaaatagttaacaaccctaatattgtaaaatttgaaaactgatagcagctgtcatttataacaattcttgggctgtttaaagggtacatttgactatagctaaggaaattgaatctcactttaaaaatgaaccacacaaaacttcaagaaacgaaatagaaatcaacatttactgcccgtaatattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggcctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagcacacctgctagtccttcccccttgtaagcctttgactttgtaatccctgggctaaaggaaacacattattcaacaaaagtgtttcatgtttgcccactagttgttggggatgattaggtggtgagtgaatggcatggggctttcctttggggaccatatactctaatggggaagggggacagacaaatagttgtaactctgtcatggaaaagagaagtaacttggacagacttttggattcaggccagatgaacatctccaggcagagggaacagcagcatctgcaaagtcctgggagagaagaaaagaatctgaacattaagtggcttcctgaaaatcgactgcccaggccgggcacagtggctcatgcctgtaatcccagcactttaggaggccaaggcaggaggatcacttgagtccaggagtttgtgaccagcctggctaacatagtgggacccagtctttatttaaaagaaaattgcccgttaagaggcttttctaaaatcttgaggtgttgataggagctttatgttttttgacttgattgttgtagtctacttcgctgcgatttgcttctgctctagttatccttcatcctctcaaaggctgtctagcaagatcttaggtctaaagtaaagtcatctcttggtatttgtcgggaactggttctaggacttcctttggatatccaaattcgcagatgctcaagtctctggaataaaatgatgttgtatatgcatacaatctacacaaatcctcccgcttatgttaatatttagattacttataatacctattataatgtaagtgctatgtaaatagttacactattgtttaaggaataatgacaaaaatatacatgttgactacagacacaatgttttttggaatattttgtctggttgtttgaatccacggaagtggaacccatggatatggagggccaactatatagaaccttactctagaccaagaatgtacttgtaaaacaatttcaaagaagcacttaaaaataagattaaatacaaaccaacagataaaagtcacaggtgctatggttgtttgatggagaatggggaaggaaatctgtcctaaaagacattataaacacagtgacctaagtggaactaaattggatcgaggaaatgataggaataggcctcatttttctgttgaatggttcaggaaccttttttttttttttttttttttttttttttggctgctctagccactttctagctctgtagtttaggctggagtgctgtggcatgatcttggctcactgcaggttctgcctcccgcgttcaagcgattctcctgcctcagcctcctgaggagctgggactacagacacctgccaccacacctggctaattttttgtatttttagtagagacggggtttcaccatgttgggccaggatggtctccatctcctgacctcgtgatctgcccgcctcggcctcccaaagtgctgggattacaggcgtgagccaccgtgcccagccctgccacatcttttttgttagttgcagtagcaatacaaccttatctagaaaagctggccaaaaaagaaaataccatgataatagggtacctaatttattgctttatttaagaaaaatgtaatatttcattcgaataagtacttttgggctgggatgatatttcatttagctacttggcatgccacccatcttagggaattatatgagggtttatactttaaataacataaaaagcaaaacatgctgaatgtaataatttgagagaagtgtaaataataaaaatctgtcatctacca

SEQ ID NO: 197704 - DNA, 676 bp, Homo sapiens
  Payload ID: 18981
  Gene Name: ubiquitin-conjugating enzyme E2N
  ENST ID: ENST00000549490
  CDS Start-End: 15-278
cgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaaataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctg

SEQ ID NO: 197705 - DNA, 607 bp, Homo sapiens
  Payload ID: 18981
  Gene Name: ubiquitin-conjugating enzyme E2N
  ENST ID: ENST00000552442
  CDS Start-End: 52-369
ggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagca

SEQ ID NO: 197706 - DNA, 3018 bp, Homo sapiens
  Payload ID: 18981
  Gene Name: ubiquitin-conjugating enzyme E2N
  ENST ID: ENST00000550657
  CDS Start-End: 60-518
gtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaaggtaagtgttatctttatcagcatatgctattattaagctttctcctttttctcttaagcattccatgtttagaatgtaaacattatacaaagatcagagaggtctgtgggagggaagtgaagcagttctgggcctgtttttttcatgctttatcatactgggcctgttgccttcatagataagtggtccccagcactgcagatccgcacagttctgctatcgatccaggccttgttaagtgctcccaatccagatgatccattagcaaatgatgtagcggagcagtggaagaccaacgaagcccaagccatagaaacaggtatctaatattcattctccttcacaccacttccacttttacaaatttgtattaccacttaaacttttctaaagctcttggcaaggaaaagaaatagaaaaaagtataataagtgagatcctgcttatagtatgtaaatacgtcttaacaaaatggcttgctatgggaccccccaaatataaagacaacctgtaattgaaagatcttggagtctcttgtaactacacctggtttaacaaatactgagtgcataccatttatctagttatatgtaaagaatactggaaaacttgaactgtttttgtaacccatttgattaaagtattcagctgtttatggctacggaatttggagtcaagaagcttctgctacagattttaagaaaattagtggggagaattgtgtatctagaaatggacaacttgattcatcctcttgaattttctagaacttcttaattttattgtagtgttttggtaattggacatttacaaaatctttcagccctgatccaatttatagaaaaaggcgtgaatttaacagattacagcatgacatttccataattaatagtggttgtttgccatttatagtttggaaagtaacatattgaactaagtaaaataataatcgtatgtttgtttctgtctacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacat

SEQ ID NO: 197707 - DNA, 960 bp, Homo sapiens
  Payload ID: 18981
  Gene Name: ubiquitin-conjugating enzyme E2N
  ENST ID: ENST00000549833
  CDS Start-End: 394-663
gctgcctgggtcccgggacgtgggggccccgcgccccgctgcccttgcttccgcgatctctctcttctgaatacgtttccgctcgtttatctctgcgaagtgattttactctgttcaactgctctgcttccatctgttcttgtcttgccttacctattatggagtcctcaggcattaaattttgttgtgattgctgcatttgaaaccagaagtaacctgaagaaaaagggtcgagaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtg

SEQ ID NO: 197708 - DNA, 1185 bp, Homo sapiens
  Payload ID: 18982
  Gene Name: ubiquitin-conjugating enzyme E2N-like (gene/pseudogene)
  ENST ID: ENST00000618570
  CDS Start-End: 31-492
gatgagaccagaggccgaactcaggttctgatggccgagctgccccacaggatcatcaaggaaacccagcgtttgctggcagagccagttcctggcatcaaagcagaaccagatgaaagcaacgcccgttattttcatgtggtcattgctggggaatcaaaggattccccctttgagggagggacttttaaacgtgaactattacttgcagaagaatacccaatggcagcccctaaagtacgtttcatgaccaaaatttatcatccaaatgtagacaagttggaaagaataagttgagatattttgaaagataagtggtccccagccctgcagatccgcacagttctgctatcgatccaggccttgttaaatgctcccaatccagatgatccattagcaaatgatgtagtggagcagtggaagaccaacgaagcccaagccattgaaacagctagagcatggactaggctatatgccatgaatagtatttaaattgatccaatcattaagtgtgcatcacttctcctgttctgccaagacttcttcctttttgcttgcatttaatggacatagtcttagaaacattacagaataaaaaaacccagacatcttcagttatttggtgattaaatgtacattagcaaatctatgtcttgtcctgattcactgtcataaagcatgagcagaggctagacgtatcatccggattgttgtgaaacgtttaaaagcagtggtccctccctgcttttattcatttcccccatcctggtttaagtataaagcactgtgaatgaaggtagttgtcaggttagctgcaagggtgtgggtgtttttctttatttttttgaggggggtaagtagttttattttaattttatgggctcctttccccgcctttttggtgctctaattggattggttaaaagcagctaaccagttctttagaaatatgctctctatccaagtctaactttatttagacactgtagatggacaagcttgattgtttgaaccaaaatgggaacatttaacaagcatcactgccctcactaataacattgtgactttgctgtcaagtgtagagtccccccttcaaaataagcttgtgaccattttgtatggcttgtctggaaacttctgtaaatcttatgttttactaaaatattttttgttattgtaaaaaaa

SEQ ID NO: 197709 - DNA, 5436 bp, Homo sapiens
  Payload ID: 18983
  Gene Name: ubiquitin-conjugating enzyme E2O
  Uniprot ID: Q9C0C9
  ENST ID: ENST00000319380
  CDS Start-End: 66-3944
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggactccggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagggcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaaagccaaagcatgatgcgtcttgtcagccttaagtgggctccacacctgtgctgtgctgtgaccgcccagccagcagagctgcgggaggatggagccggaccacacaccgtggcatttggaaccgagtcggtatcttgtttgagaaacacccggagtgactggtggggctgtgcttcccagtgcattgtacatgtggagatgtgaatgcctactgcttacgatatctgtataaagtgctgtgtgattaaacttttttttacttgcatttttttttttttttttttttgtgttggctcattagcaagacaaggtgacaccattaaacctccctctgccattcatctgg

SEQ ID NO: 197710 - DNA, 567 bp, Homo sapiens
  Payload ID: 18983
  Gene Name: ubiquitin-conjugating enzyme E2O
  ENST ID: ENST00000590658
  CDS Start-End: 1-567
tgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtgaagcgcctgttgaagaagcaggttgtgcggatcatgtcatgctccccagacacccagtgttcccgggaccattccatggaagacccagacaagaagggggaatccaaaaccaagagcgaagcggagtctg

SEQ ID NO: 197711 - DNA, 3569 bp, Homo sapiens
  Payload ID: 18983
  Gene Name: ubiquitin-conjugating enzyme E2O
  ENST ID: ENST00000587127
  CDS Start-End: 1-2423
acacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagcagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagggcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaactcaaaagcaaagatattaactcttattagaaaaaaagacaaaaaaaa

SEQ ID NO: 197712 - DNA, 3210 bp, Homo sapiens
  Payload ID: 18984
  Gene Name: ubiquitin-conjugating enzyme E2Q family member 1
  Uniprot ID: Q7Z7E8
  ENST ID: ENST00000292211
  CDS Start-End: 81-1349
gcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaata

SEQ ID NO: 197713 - DNA, 3130 bp, Homo sapiens
  Payload ID: 18985
  Gene Name: ubiquitin-conjugating enzyme E2Q family member 2
  Uniprot ID: Q8WVN8
  ENST ID: ENST00000267938
  CDS Start-End: 383-1510
cgggcgcgcgcgctctggcctcgtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaattttgtttgtgctgatcatggcaagcaaaaaaaa

SEQ ID NO: 197714 - DNA, 2158 bp, Homo sapiens
  Payload ID: 18985
  Gene Name: ubiquitin-conjugating enzyme E2Q family member 2
  ENST ID: ENST00000426727
  CDS Start-End: 1-601
cctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaa

SEQ ID NO: 197715 - DNA, 478 bp, Homo sapiens
  Payload ID: 18985
  Gene Name: ubiquitin-conjugating enzyme E2Q family member 2
  ENST ID: ENST00000567921
  CDS Start-End: 1-276
aatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatgataactttccatttgatcctccatttgttcgagtggtgttacctgttctctcaggaggaatcaatataatctagcaagagcccaacaatcctataattccattgtacagatacatgagaaaaatggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatat

SEQ ID NO: 197716 - DNA, 1582 bp, Homo sapiens
  Payload ID: 18985
  Gene Name: ubiquitin-conjugating enzyme E2Q family member 2
  Uniprot ID: Q8WVN8
  ENST ID: ENST00000561851
  CDS Start-End: 311-1390
gcgtctttccggcttctcgccaggggctggcttgggggcttctggcccatctcggtccccgtctcctagccccgaggggggagtccgcggcggcccaagcccttgtggggtccatggccgccctcagccggcctgctcccgggaccggggcggggcggggcggggcggcgcagctccggctgttgtttgagcccaggccggcaaggggaacggcccttaagttttaacgcctcatttttcagtcggattttccttcttcccgcttgttcagccaattgtttttaagtttgcgtttaaggagaaactgacaatgagaatggactcgttgacggaggaaaagttggaatgcagactctggtgctgtttgagcgacccctctcccccgggcctggctgcgcgctgctgtgttctggaaaggagcatagtaccgtcgttgcggcaggaatcctatccatcttcttcaccgatatggtttgtggattctgaagacccaaatctgacatcagttctggaacgtctagaagatactaagaacaacaatttgcttcgtcagcaattgaagtggttgatatgtgaactctgcagtttatataaccttcctaagcacctggatgttgagatgctagatcaaccactacccacgggtcagaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatctt

SEQ ID NO: 197717 - DNA, 2969 bp, Homo sapiens
  Payload ID: 18985
  Gene Name: ubiquitin-conjugating enzyme E2Q family member 2
  Uniprot ID: Q8WVN8
  ENST ID: ENST00000569423
  CDS Start-End: 361-1383
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatgtgttgactgttgtatgtttggactaatgttgctttaaagaaaatctttctaacatgcagacaaaagctttgagtgcccctattacagcagtaccgaagatgttagttaatagatattttagtggataatctgtcatctgacatccagtataagttacagcctttgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcaattaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtgacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaa

SEQ ID NO: 197718 - DNA, 575 bp, Homo sapiens
  Payload ID: 18985
  Gene Name: ubiquitin-conjugating enzyme E2Q family member 2
  ENST ID: ENST00000561723
  CDS Start-End: 100-456
cccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttggataactttccatttgatcctccatttgttcgagtggtgttacctgttctctcaggaggaatcaatataatctagcaagagcccaacaatcctataattccattgtacagatacatgagaaaaatggctggtacacccctccaaaggaagatggctaaatgtgttgactgttgtatgtttggactaatgttgct

SEQ ID NO: 197719 - DNA, 499 bp, Homo sapiens
  Payload ID: 18986
  Gene Name: ubiquitin-conjugating enzyme E2Q family member 2-like
  Uniprot ID: H0YL09
  ENST ID: ENST00000558195
  CDS Start-End: 13-408
agaacggaccagatgggtccagcagtgctgggtcaaggccaggaggggcagccggaagcgcgcgcatgctctggactcctgcagccgccgaaacggccaatcgtgtttaaggagaaactaacaatgaaaacggactcgttgatggaggaaaagttggaatgcagcctctggtgctgtttgagcgatccctctatcccgggtcgctgctgtgttctggaaaggcgcattgtaccctggatgcagcaggaatcctattcatcttcttcaccgatatggtctgtggactctgatgagccaaatctgacatcagttctggaacgtctagaagatactaaggagaacagttcggtgaggaaagaaaccaagctattttctcttttcctcatgaacattatatttagaaattaaatgttaagtgataatattatataaaaacatgattaacaactgtaatcttagaggaattaaagtctgggtattttaagtcctccaaatctta

SEQ ID NO: 197720 - DNA, 4317 bp, Homo sapiens
  Payload ID: 18987
  Gene Name: ubiquitin-conjugating enzyme E2Q family-like 1
  Uniprot ID: A1L167
  ENST ID: ENST00000399816
  CDS Start-End: 272-757
gcagcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccagggacggatctgtagaaaagctggcaaatcaaaaaagtccttcagtcgcaaggaagctgaagctacctttaagagtttggtgaagacgcatgaaaaatatggttgggtcaccccgcccgtgtccgacggctgatgtctgccacgtgcagtagacgctcgagcgcctgtccacacacacaccagtaccctgacatctcctcaatgctgtgcatcctccacccgtttttactccagccagaactgcatcctgaatgcccaggagacgtttaagttatttatgaaaagatgtgtgtacagagaggaagagggagcaaatgccgttcggattatgtttcgattataaatgaatgatcacctcgaagtcactttagaacacatgttgagatggtgacatttcccagcctgcctgcccctctgcccaccccggtcacattgccctgagcttctttccatgacagcagctccgacgagccggcaggaaactcaatgcccctgctggctccatttccatgtaaatggcgccgttcatatttcacagggacgccgtgcatctccgccgtgcgtccccggcacgtgtttgctgtgctctgtatctctgtttttcttcctggaaggtcaacataacttgaaaatgtgtctttctgtggcccatggtccgctgtgatgacatttagacctcatttgtgctatgacctttggctcatgaaaacacaaatttaacattgccaggttctagtgatttaaaaccacaactgcccacttggtgaaaacgtgctctcgatgctgatttgtggtgtgctgctgtccacagataaaccagtgccattagatggaaggcagaggatactgcgaccacccctggcagacggtggcgtagacaccaggtgcgccctctggggctcagagcaacggatggtcagctgcgaacagtctcgtccgatgttaggaaatggtcctacggccgcgcctttgtgttcctgtcttctctccaccaccaaaagcaaaagatgatttcccattcactgcagtcatctgactcattttaatatctgtgctagtgacaatgaatgtcagaactgccaaaggataccaagtgatcatacgatgatttgcatgatcgggtctatttcacccaatagtcacttgtgtgtcccccgaaattgggatgggtgagcacccttgctgtggtgtaaacttcctgttatttaatctcccccacggtttcatttttctcttctgttaatacttagaactttctaagaaactccatgaaatgaggaaatactgtttctaataatatgaggaaagaagtaaaaatgttcattccaagtggcaagtcttattggacacattttaaataaaatcatgcatacctgatacactgcctcaaggatccagtcattgtgggctatccttccatttaaaatatttcagatattcttaaattttttaaatattgcaaatactacaacatgtaattccagagcagcgttctaagtcaggtaccagaaatgagtcttaggaacccatagtctttgcaaaaattcagtagattgaaatagtccccagaagcagccaaggagctgaagggatgattcgatcaagttcagatgttgccaattgtatcttactgctgtgaaggaggaaaagtcttccgggataatgtattcaattcttcaggcagttttgtctacttggggacctgcccattggttcaaggttttcagagatccaagaggccttgcctcaaagaacaaggattggcgcctttcagcagggctgcccattcaccaaacttattgttacttttgtttttctttaccactttcttatttgcccccaagtgcacacaggcagctctgccagaccaaaatgacagtgtattaagaatgcagggcctgctcagcttccctgtgagtcataatagtcgtgaaacttgatgacagtgaacttacgatgttcattcatccaaccctctatggtggcattctccatcctggaaacctgacatttggctgacggtctttggaccctggagctagtggtcatcatggaattacactgtggagatgaaagacctaggacagaaacatcttgctagggaaagcacctgagtttattcctttctaaatattttcctcttctaatgaaaactaaaagcagctttactttagggggaaaaatatatccaaaggcaggtcatttcagtagtgtttattagctgattgaaaaacaggttcacggtgctctctgagaactgcaccaaggggtgcagccaagagactggtctgaccccgggttgggctgggtggcagccggcgacagagcagagagacactcagctcagtgtcgctccttccatacactcagagtttgatttttcttgcatggcatttccattaggtttgttagaaacttatagaagaaatcaattctttagtgaacgaaataccatttttcactcaattggtaagaatttttcattttaaaagcagtaggaagtgatgtaaaactctaccattgcttggactgttaggagtgcggactccctttctggtagactcccttcgtaggcaagcacggtggtgcccagccatggaggcacccttaggacactgagcacaggcctggctgcctgtgccttggccacagcctccttccaccccactgaagtggacacctgcctctggagcccagggtgagaaggagaggcctgaagcctggggccacgttcccacacaagccaaggaacctattcctctttggacagacagcgagggaataatcagacagtgggtgcaaatgttcatgtcccgatagctccacacacccatgtatctgtgggaactcaaaccaagccagagcccacagagccaaacaaacagaaaatcacaaacccatctgtcctcttctcaatgcagaactccttcccgtccaataattttcctgaaccaatcacccttgttattgggtatcttctccactgctgggtaaggcctgcacatggtctgtctgtaactttctagaagactgagaactgcttatgccttagggagttctatgtgagcagcaaggttattccccctagttacacacacacgcacatgtgccaatactcctgcaaagacttgctgtttctaaaatccactactcagaaaaaccagggtgtcggcttaaagttttcagctccatctatcaaaatttgacctttttttaagagaaaaatatgtagatgagtgaaaaagacctaggattgaaagacaaaaagccatgtgtccatgtaaccctggccagtcactccacctgcctgagccttggtttcctcagctgtgagctcctaccaggtcagtgtgggaattggccaaaatgacgcagcagaagtgctttggagactaaagattgtcaacgaaatgtaagtgtcattttcgtagtattaggacgtttacattacagcaggctttaattagaacccacttagatatcgactcagaatgatcaattacagtggttaaaatacacatacctggtaatcatatacttgctttctgtccccagttcttacattaagtcaaccaactgacccaaaaatcaaccaataactaactggccatctctccactcactcagcattctcctcttaaatgcagggcatgcagaagattaaggtacagccccttccctggataggaactc

SEQ ID NO: 197721 - DNA, 4075 bp, Homo sapiens
  Payload ID: 18988
  Gene Name: ubiquitin-conjugating enzyme E2R 2
  Uniprot ID: Q712K3
  ENST ID: ENST00000263228
  CDS Start-End: 192-908
tcgtgtgtgaggaggaccccgggcgggcccacgggccgtgtggggcctggtctggcccgccgggtgtgtgaagaccggggcccggtgctgcccggccggagggcgagcggaggggaggggcctggtccggcccggccggtgcgtgaggactggggcccgggcccggcgccgccgccgccgccgccgccgcgatggcccagcagcagatgaccagctcgcagaaggccctgatgctcgagctgaaatccctgcaggaggaaccggtggagggcttccggatcaccctggtggacgagtccgacctctacaactgggaggtggccatcttcggaccccccaacaccctctacgaaggcggctacttcaaggcgcatattaaatttcctattgactacccctattcaccacctaccttcagattcttgaccaaaatgtggcaccccaacatttatgagaatggagatgtatgcatttcgattcttcatccgcctgtagatgacccacagagtggagaactgccttctgaaaggtggaatcctactcagaatgtgaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcgtgacgtgctccttcagtgcccctgtactgccctgccatctcaggccaaagggaggggagcaagtggggacctggccatggcccctcagcaaaaacctattcacagcgggtggggaaacacacacagctcctgctgactccccttatggatctcagtttgctcctttttatggacctttaatggagagagagtaaccctccacagaatgtctgaattcttgcattctttacccttccatcactatattgattctttttttaaaaaatatgaacccaaactcccgcctcacttcgtctctacagaatgttcacagcaaaacacgtttggtctgtttttagattcttgaagaattcaatagtctttcaagatgtttaatgtgtttaaagctgggaacctgttgggagttcacaagtgctgcatatactgggtagcaaaagaaaatggaaaaaaacccacaaaacaaactttaaaaaaaaaaaaaaacaaatttgccaaggtttagctgctcatttacattagtgtgtgtgcattcgttcagccccatggtggtgaattctgtttctttcctttcctaaggctgggacatggtgggcatcagggactttgtgctaagcctgatgaaatgtgctccttcaatctccatgaaaccatcgtaacatggaggcctcagctgctctgaggagagaaatcagactttgttttttgaaatcgattgggatcgaaagcctgaaataaatattcatactttccatagaactgagcacttggttgctatttattttaaaggcagggttatttccccccagggagtggggcaagcggggaagttgggatgagtgcgtgtgggagcaaagagttaaaaatcactatgctaagtttggttgatgctactggggggaaaaagttgaaactactggtgaccactgttgggagaggaaacatctgttttatagatttagcatggccttcccatcaaaaatacactcgtaccatgacgttttgtttttgttttttaagtagccacttttaattactcagtattaatcctaggtgcatgtgttaagatttcggttttcatcgagctgcttatactgatagtgaaaaacttggatgtgtgtgagacgagttaccgccttcttcattggatgtgatctgaactttttttctcctttcaacatacttaggctgtggagtgcaagcagaattatgcatagaaattgtggcagggctgagggagttgactgcaggcagtttttaggccagataaggctagatcttcctgcaatgcacttgctgcagctttgattttccagatctcaatcgtgttgcttcaatcaatattgagatccagcagccttcaccatccaggagacttcagaacttgaaggtaatttttggttgttatgggggtgcaccagatcataggagggcattatttggaggaaaccgctataatgtaaaatcagatttcagaaggaaaatgcagcaaggactgactgtagtcctatttcagacccctgggcactagtgtcaactcctcctttggctcgtaactcagaaagaaccaaagggcagattagggacggggcaggagggatcctaggatggccagagtaggtgacgcttacttccttagctcctccttccattctgatctcagggttttcactcttcaaactcccaaacacatgacttcttcccagcagcccttcccggcctctaaagtttggtcccagcagcccttcccagcctctaaagtttggtctggtatgaaatgggactgtttaacaagcaaggctcttaggggacactgttgagcctggtcccagaatctgtgatctccacagggccagggttgctacttgcacccagaatctagtgattttagtcagatccatggaacagagcagcttcgtaatacattgtcaagttacctgattacaaactctcatagatgttggaactacctttttactccccatactttgtaagtaatgcttccagattaacctgcaaatcttgtggagccaaagcctctcacagtgctgatttacctcccccaaaatgcccccaaacccccatgcaagtttacagccagtagcttggtcttattctcttggagccctaaaattaagcctttcattcccctttgctaaagcatctcactcccagggcagccccagcaccctggcattgcgggaggtgctctgctgcacagctgttccatcaggccctattggcctctgttagacattgactcagggagccggagcgccaagtggaggttgtacctttcagccctttggggtgttaaaagtgtcaagggctgggtttgcctctgatgagtacaatcagttccagaagactgggtaagtctcttgctagcaggtggacattctggtattttagactgactgaacgaaacccagaggctggttccagagctctgtccctgagaacacatccctgtggaaaatacttgagtttgtaattttttttcccccttctgggagtggaggtctcaggctcaatccggaaccatgtacgtacagttttgcttattatttgatgtgacatgaactcaaaatcctgcatttttagattccttttagttctaattgaggcctcactagatgctcttcagttctgtgtattttgaggctgggtggagaagtatatgattctgctgttgattctttcagtcttccccccttctccttttatcaatcattccagagttattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcagatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcccatctgtctactaataaaatgtgaaataaaatacctgtattgctacttccccatgaaa

SEQ ID NO: 197722 - DNA, 2548 bp, Homo sapiens
  Payload ID: 18989
  Gene Name: ubiquitin-conjugating enzyme E2S
  Uniprot ID: Q16763
  ENST ID: ENST00000264552
  CDS Start-End: 189-857
gccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcagcttctgtgtctcacagatgccccaggaccgctgcatggtgccatgtggctctgggagtttggctcccctgcacaggccctgggtccttgtaaagcctcatggactgcagcagtgggtccatctagctcaccagccttgctgtttgaggtttgggtccacctctttgttctgtggaggtagagcggtcacaacccctctttggagtcagatttccaatctaaaatggggcgaggacctggagctgctcctggtggcctgagcggcactgccctatacttctccctctagaataatggccacgttggtgtggcagtggtgttcctgctcaggacggccaggtgccagcagtctggcatgaggctcgcctcgtctgtctggttctggactgggccaaggttcggtccccttgaatcatctgatcctgctttgtgctaaagattggtttttcccttgtgggcagcaaagcctgttcccacatgtatttctgcacaacagatcacaaagccagcggcttaaaacaacacccacttcagactttgtgttggaagtctggacacggctgagctagtctctgctcagtgctttgcaggctaaaattgaggtattggttgttggtgttccttagtctgggtcctcttccatgctcatggttgttggctgatttcagtcctcgtagaactagggtcttagctccaagaagctgcccctccttgggccctggcaggtctgatttaagggcccattccctttgaggtgctcaccggattaggtcaggcccatccagatacttaagtgataatgactaaatcacaggggtaagatcccagcttagtcttagtttctgccctcaaggggaagggattaacctgggtgtgcacaccagggggtggggaaacttcccattctattaatgcgtttaggttatttagaccaatgtctcattaattttaaaaaaattaaaaataggccaggcgcaatggctcacgcctgtaatcccaactttaggaggtgaaaggatcacttgaggccaggagttaaagacgaacgtgggcaacacagtgagatcccatctctacaaaaagtaaaatacatttacaataaaaatctacaagttctgacccataggagagtggaaaactcaaaggctgcttttgtcctgaaagaatttgcctattctaataaaacagctgaggttgaaacggctcagcctctgaaaggggtctgacccttccttgagcccttgcctccagtgacaatctcccaagctaagggagaaaaggaaccaaaagtctgcactcctctctacctctagcagtgcagggagcgaaggaaagacaagggaagaaacccttcagattttcagatcaaattcacatcactggccatccaagaaatcttaagctctgcgtttatcgtcaaccatttctgcatgagggaagcaaacagtccttgctgaaggaaggtgcctgcatcctgggcctcggaacccactgaaataatttagcgaagtgcataataaaaataatatttgccctta

SEQ ID NO: 197723 - DNA, 496 bp, Homo sapiens
  Payload ID: 18989
  Gene Name: ubiquitin-conjugating enzyme E2S
  ENST ID: ENST00000589978
  CDS Start-End: 183-422
caccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacg

SEQ ID NO: 197724 - DNA, 743 bp, Homo sapiens
  Payload ID: 18989
  Gene Name: ubiquitin-conjugating enzyme E2S
  ENST ID: ENST00000587845
  CDS Start-End: 131-743
ggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgctttcctggaaagacaaacagtgccagacccaggacacccaagtactgttgagaagtgcccaggagcaccttactatgcaacgagtgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactg

SEQ ID NO: 197725 - DNA, 922 bp, Homo sapiens
  Payload ID: 18990
  Gene Name: ubiquitin-conjugating enzyme E2T
  Uniprot ID: Q9NPD8
  ENST ID: ENST00000367274
  CDS Start-End: 151-744
ggagccacgccaacagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttga

SEQ ID NO: 197726 - DNA, 1136 bp, Homo sapiens
  Payload ID: 18991
  Gene Name: ubiquitin-conjugating enzyme E2U (putative)
  Uniprot ID: Q5VVX9
  ENST ID: ENST00000371076
  CDS Start-End: 245-925
ccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaaatgaaaaatctttctttggaagcagcataggggaagagcatgagcttcagagtcaaacagatgttggagaaattcttaaccactctgaacttgtttttttatctgttaaatggagataaccttacctatcttgcaaagttgttttgcatttgacgcttattattttatatatatgatttcattcgagatataaataaaaattatataaaaatgtg

SEQ ID NO: 197727 - DNA, 1193 bp, Homo sapiens
  Payload ID: 18991
  Gene Name: ubiquitin-conjugating enzyme E2U (putative)
  ENST ID: ENST00000371077
  CDS Start-End: 425-1193
gatttgcttcctccggtgcgtggctgcggggttgcacctgtgaagcgaagacaacctgctaggaccctgataggcgtacacctctcactcccactcacgcgccgacgacatgggcttgtctccgttactcatccaagtttgtcttgagactgggctgtgagccggcactgcagtgaaacgccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaa

SEQ ID NO: 197728 - DNA, 444 bp, Homo sapiens
  Payload ID: 18991
  Gene Name: ubiquitin-conjugating enzyme E2U (putative)
  ENST ID: ENST00000608956
  CDS Start-End: 1-403
gatgacagccaggagttacctaaagacccacgtaaatgtatcagtgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaaatgaaatttttcttgagtcaccaactgcaataaatagcatcacagacatttatgaaacagaagaggaggggtggaagagtgacacttcattatatgaaaatgacacagatgagcccagggaagaggaagtggaagatctgatctcctggaccaatactctcaatacaaatacttcagaagattaagcagaacattatcagattcaaaaaataaacagcctccgcca

SEQ ID NO: 197729 - DNA, 775 bp, Homo sapiens
  Payload ID: 18991
  Gene Name: ubiquitin-conjugating enzyme E2U (putative)
  ENST ID: ENST00000608020
  CDS Start-End: 1-615
gttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaaatgaaatttttcttgagtcaccaactgcaataaatagcatcacagacatttatgaaacagaagaggaggggtggaagagtgacacttcattatatgaaaatgacacagatgagcccagggaagaggaagtggaagatctgatctcctggaccaatactctcaatacaaatacttcagaagattaagcagaacattatcagattcaaaaaataaacagcctccgccatagcccagcgttgtggagcaattttggaagactctcagaacttggatttcattttttttaagttgttctcacccactcactgcaagtacaaattagaaatataagtacaaatcagtaaa

SEQ ID NO: 197730 - DNA, 1550 bp, Homo sapiens
  Payload ID: 18991
  Gene Name: ubiquitin-conjugating enzyme E2U (putative)
  Uniprot ID: Q5VVX9
  ENST ID: ENST00000611228
  CDS Start-End: 425-1390
gatttgcttcctccggtgcgtggctgcggggttgcacctgtgaagcgaagacaacctgctaggaccctgataggcgtacacctctcactcccactcacgcgccgacgacatgggcttgtctccgttactcatccaagtttgtcttgagactgggctgtgagccggcactgcagtgaaacgccgcagatgaggaagtgcccaagtcttccttcgggaagttctcgtttagaggagtcaggagaaaaagtcattgttatatcccaactttagaagccgcttatcttggtaccgttctgaggttctagaaagcaagtaacttatatcagtttactaagtgtgggaaagtgacccataacttcaaacatctgcctcagagtaaacctgaggcatttggggacaagtgtcagaccctccgctgcctatcatgcacggcagagcttacctcttgctgcacagagacttctgtgatctcaaggagaacaattataagggtatcactgctaagcctgtaagtgaagatatgatggaatgggaagttgaaattgaaggtctacagaattcagtttggcagggtttagtcttccaactgacaatacattttacatcggagtacaactatgctcctccagttgtgaaatttataacaattccgtttcatccaaatgtagacccacacactggtcagccctgtatagactttttggacaaccctgagaagtggaatacaaactatacattgagcagcatcttacttgccctacaggttatgctttctaatccagtgctagagaatccagtgaatttggaagcagccagaatactggttaaagatgaatctctgtacagaacaattctaagacttttcaacaggccattacaaatgaaagatgacagccaggagttacctaaagacccacgtaaatgtatcagaccaattaaaacaacctcatttagtgattactaccagacatggtccagaatagctacatcaaaagccacagaatactacagaactccattgctcaaagttccaaatttcattggacagtattacaaatggaagaaaatggatctacagcatcagaaagaatggaatttaaagtattccgttatcaagtgttggcttgctagaaaaagaatgcctcatgaagtcactcactcaatggaagaaattaagctctgcccaactctaattcccaccacagatgaaatttttcttgagtcaccaactgcaataaatagcatcacagacatttatgaaacagaagaggaggggtggaagagtgacacttcattatatgaaaatgacacagatgagcccagggaagaggaagtggaagatctgatctcctggaccaatactctcaatacaaatacttcagaagattaagcagaacattatcagattcaaaaaataaacagcctccgccatagcccagcgttgtggagcaattttggaagactctcagaacttggatttcattttttttaagttgttctcacccactcactgcaagtacaaattagaaatataagtacaaatcagtaaa

SEQ ID NO: 197731 - DNA, 2315 bp, Homo sapiens
  Payload ID: 18992
  Gene Name: ubiquitin-conjugating enzyme E2W (putative)
  ENST ID: ENST00000419880
  CDS Start-End: 1-576
atgttgagcccccgcggcgtgacgcgagcacggcagctcctccccctgcgtctctggcctcgccggtcttggggggatggttccatcatggcgtcaatgcagaccacaggaaggagggtggaagtatggtttccaaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataac

SEQ ID NO: 197732 - DNA, 3903 bp, Homo sapiens
  Payload ID: 18992
  Gene Name: ubiquitin-conjugating enzyme E2W (putative)
  ENST ID: ENST00000422906
  CDS Start-End: 54-236
agctcctccccctgcgtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaagaattcagtgtcactagttctaa

SEQ ID NO: 197733 - DNA, 8426 bp, Homo sapiens
  Payload ID: 18992
  Gene Name: ubiquitin-conjugating enzyme E2W (putative)
  Uniprot ID: Q96B02
  ENST ID: ENST00000517608
  CDS Start-End: 2-544
gatgttgagcccccgcggcgtgacgcgagcacggcagctcctccccctgcgtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaagaattcagtgtcactagttctaagcctttatggttactgctgcttatatttcttgatctcactttcattaatttttttgtacatatcttagctgaatgcttaaaatttacaattatttgtaattgtgtatgtaaattgcttttcaaaaagaactgaagcttaaccatattcttcttttctgaggattcattatcagaatcagctactatactgttctgtgttatagtaatgccgttactgcctgtgcatgattgaggtctgtgaagaaggtgtcttttaatctgcaccaactggccccaatcctctttgtagtcctttttaaattgttttaaatctgtcctttatttttcttcctatttttctgcctcttcccactgatgtccaatgtgtcagtcttccgcagtttccttttctcacttctaatttattctctcttttttttttctgaggttagggattctacagaaggacgattattaaaattatgccatgaatttttgaaaaatttaaaatgctctcctacaaataaaatacatggagtttctgatactaatttcagtttgtcagtagatggctaaatttgttgaataattgactacttggtaaatgagctgttagctgtaattagttctttagtactaatattaaggaaattttgttattttcggatgaggactctcccaaagccaaattattgtccaagcaaattatttattttttccatttaaatttctaagtcattttgagatgtggaatgattatttttattatttatttatttatttatttttgagacggagtcttgctctgtcacccgggctttagtgcagtgcacgatcttggctcatttcaatctccacctcctgggtctaagcgattctcctgcctcagcctcttgagtagctgggattacaggcatgtgctgccacacctgactaatttttagtagagacaaggtttcaccgtgttggccaggctggtgttgaactcctgacttcaagtgatctgcccacctcagcctcccaaagtgctgcgattacaggcatgacccaccacacccagcctggaatcattttttaaaaataatttgtgggagacttgctttctcaacataaattgtgtgtgggttgttttttgttttttgagacggtcttcctctgttgcccaggctggagtgtgcagtggaacagtcattgcagccttgaccaccttggctcaagcaatcctcctgcctcccgggtagctgagtctacaggtgtgtgccaccatgcctggatggatagaatttttttttttttttttttttttttttttttttttaaagacacgaggtctcaccatgttgcccaggctgatcttgaattcctgggctcaagcattcctcctgcctcagcctcccaaaatgctgggattacaggtgcaagccaccatgcctcgtctgtttgccgatttaagacaggtttatgtacatcattatcattagaggcacatagaatctagacatgtacttgaaacttagctctctatcctgaaagttgaagttagggttctttgatcctggtgagatgttaattgtaattttaattttcatatgttaatattgtgacttgtattttgtgatgagtctctagaatgattaaatgactatttttttatgaaaaattttttgttaataaaatatctgagggtattttgagtatgtggaaggaatgcctgaatagaagctgatctatcttaacatacctcaagaactccagttttaatatggtgagtgaggagttgactgggaaaaggagagatccaattcttgttctagtccttggcacatacactctctgggttttgagaaaaggatggtcctacaacgattctaagttgttttctcattggtcctacaacaattctaagttgttttctcaaaggcaaaagcatgatttcaaaatgacatcacttgtcagattttctggtgtatggaaagatttaataatcctgcctcttttgaagcctgaaacttacaatttaaagcctgaaatctaccataaggaacttggtaaattgtgtcagataccatgaaaatgcatcttttcatagttaaccacagattgtttatgtaaaggcaaattggtggtcaggttcaaggtaaaatggattattgggttgattagtagccaaaaactaaatgcatgttcaggtcaaaatgaatttgtttgttttagttggtgccattttccttttattattcagaactacagagtgtgcattttattaataggaatgaaagctcatgcttgaggatttgaatagggtggatgtatatattttataaactcaagttgcaaaatatgtaaagtcactactttttaaatagaatataaatgttaaaacagacaaatctatgttatatattttttaatacatgtatcagacttgttagttgaatgcagattactttgctttatggaatttcataacttttaataataaagcagttgttattggattttttctgtagacttgaatactaaatgggatagataccagacctctttttggtttatgacgtaaaagtatttgtacagtagtttctcttcacaaaagactgaattttaaaggattatagaaacaggaacatgtccatttccaaaatgagtgcaacagaatgaagatagtcacttaaaccatctatttaacacatcacctttatgtaatatgtagctagttttagtgttttaataagtcccaactaaagactgagtgttttcagtgaagatggaaatggagacccaggcacttgcttagagttatcgtgagtccgatgttcctgaacttcaagttgtacaattaagggcatactctaagaacttctggatgctttctggagtatacaaacagatcaactaatgacttaaatgagtgactcttgaagctgcaagaagaggaaagaaataaccacaagaaggggctatctcagcatctgttattcctgacaggaggaattaaatatgctctgctggtaattctaagcttttctgcaggggatctgcttgccccaggagcaccttagtcctcattgaggcagccattctgccataaaaacgatcatgtctcaagctgttcctgccgtcctacacaactatgttagtagatggttagataaatatatgaaccatcttttgtactttgatgatgcccttttcctttattataatccttaatttctactttccatagtaggatttgacttttctccattagtttaagctaccctggataagtgactctgtttatgtcctccctatatttcttactcattttcacactaacataacacgtaacaaaattaaacataagctaaattgaagaagcaagtgagacagctaagagttttgtgtacttggacaacaaagctcaaagccactgtggttatctgtcctgttgggagcccctttcaaccatttttttagttgcctgtaagatttatttttaatgtttgcctgcataatgcaaaatacataagtgggaatccctacgccctttacagttaagtggattatggaaataataaggaaagtttatcaactaaggtaggaaatatcttctcatgtctgtatctggccttcagggacttaatgtgggtgaatatatgtcattagacaagatcctaatatagatggctgtatcctgcagatagccaattcaacattaaaattttatgtttccatacctcaatgaaaacatatttcttttatcctgttataatttaatgacattcccatccaacttaatcaagcaatgatactcagtagtcctctccttgcatttttcaagtcctgttgagtgtaactttaaaatgtctctgagatttctaccttctctccagtctccttaccattagggcctttcactacctggccttggtgtccctaggctgctcttcagctgtccacaaaccttgtttcataagcagtagcaatgcaagcttccactgccgtctgctaatgttcttccctcctagaatgttcatgatctgcgtttctacctgaaaggtctagttcaaaggtagctgaaaggttatcatccttgtcctttcttctctccctaccagtcatctatcctgaactttttaacagtagggacagtgttgcaattgtgtttgtgtccccagcacgtagcacacagtacctagtatacagtacctgtagcacataggcatttaataagtgtgtattgaattaacttggttatgcttgtatttttatcctagctttctcaaagaaacttaggtgctagctattttgaaacatatatccagaaccaccacctgagtaaaatgtataacaggaccctgctctttctatcccagagagtttgagaaaactacttttaaataaatcattaatcattcttc

SEQ ID NO: 197734 - DNA, 850 bp, Homo sapiens
  Payload ID: 18992
  Gene Name: ubiquitin-conjugating enzyme E2W (putative)
  ENST ID: ENST00000523278
  CDS Start-End: 1-467
agaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgaactgaaatctgccttcatactatctattacggattgaatcatgtcctccaataagatgtgttgaagtcttaactcccagtacctcaaattgtgaccctatttggaaatagagtcattgcagatgtcattagttgaggtgaggttataccgaagtagaatgtggccttaatccaatataactggtgtcctaagaattggagaagagactcagacacatggggagaagaccatgcagtcatggggtgatgtatcaacaagccagcaaatgccagggattgctgggaacatcagaggctggaagaggcagggaaatgttcttccctagagctgtgggagagaacatgattctgctgacaccttgatcatggacttccagcctccagaactgtgagacaataaatgtctggtttcttttaagtc

SEQ ID NO: 197735 - DNA, 575 bp, Homo sapiens
  Payload ID: 18992
  Gene Name: ubiquitin-conjugating enzyme E2W (putative)
  ENST ID: ENST00000519255
  CDS Start-End: 39-221
gtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgaggcaacattttgccgtattgcctaggctggtcttgaactcctgggcccaagcagtccatccacctcagcctccccaaatgctggaattacaggcgtgagccactttgcattgccaagaaaattatgatacttgttgatgccactgttatcatcctcctagcagaagatagtcctactgagaaaatgagcactttgat

SEQ ID NO: 197736 - DNA, 747 bp, Homo sapiens
  Payload ID: 18992
  Gene Name: ubiquitin-conjugating enzyme E2W (putative)
  ENST ID: ENST00000519277
  CDS Start-End: 33-215
ggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgccatcatggattcgtagtcccgcaagtccctgttgatctagctgttacagatcatttgtttcttcaaaacgagggtattcaaagatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagctt

SEQ ID NO: 197737 - DNA, 2201 bp, Homo sapiens
  Payload ID: 18992
  Gene Name: ubiquitin-conjugating enzyme E2W (putative)
  Uniprot ID: Q96B02
  ENST ID: ENST00000602593
  CDS Start-End: 4-459
atcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttg

SEQ ID NO: 197738 - DNA, 3122 bp, Homo sapiens
  Payload ID: 18993
  Gene Name: ubiquitin-conjugating enzyme E2Z
  Uniprot ID: Q9H832
  ENST ID: ENST00000360943
  CDS Start-End: 136-1200
agcaccgtctgggctgtggaagcggagggggtggggacactctggcccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaa

SEQ ID NO: 197739 - DNA, 573 bp, Homo sapiens
  Payload ID: 18993
  Gene Name: ubiquitin-conjugating enzyme E2Z
  ENST ID: ENST00000508468
  CDS Start-End: 32-573
gctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacg

SEQ ID NO: 197740 - DNA, 766 bp, Homo sapiens
  Payload ID: 18993
  Gene Name: ubiquitin-conjugating enzyme E2Z
  ENST ID: ENST00000506498
  CDS Start-End: 1-388
agccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacatacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacaga

SEQ ID NO: 197741 - DNA, 322 bp, Homo sapiens
  Payload ID: 18993
  Gene Name: ubiquitin-conjugating enzyme E2Z
  ENST ID: ENST00000514948
  CDS Start-End: 1-213
cggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggtaatacaacccctgctgctaattgcagaagccctacagctggccatgtaaaagccccccacaagcgtggcatcgacagctgtcatagaatgacacagctaagcctgggttcagtggctcatgcctgtaatcccagcactttgggaggccaaggcgggcg

SEQ ID NO: 197742 - DNA, 598 bp, Homo sapiens
  Payload ID: 18993
  Gene Name: ubiquitin-conjugating enzyme E2Z
  ENST ID: ENST00000504684
  CDS Start-End: 126-269
aagcaccactttctcaaaccctggcctcattgaggtgataacaactgtcctgctcaagggattccccctttccccctcttcctcactccttcccccacctcctcttggtgttatacagggatatcatgtccatttataaggagcctcctccaggaatgttcgttgtacctgatactgttgacatgactaagtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctcc

SEQ ID NO: 197743 - DNA, 769 bp, Homo sapiens
  Payload ID: 18993
  Gene Name: ubiquitin-conjugating enzyme E2Z
  ENST ID: ENST00000511373
  CDS Start-End: 468-769
aataaaggtccactgtatagtttatagaattagttttttagtggagttgatgatgcctttccagttactaaaaaatcttcatttagcattcagtcgtagtacctgggaatcatggaggtggggagtgaatgaattgccatgtgggaggaagtgagagtaagtggaaagtggcttttccaggctgacatttgatgccattgggatctctgatttttttcctctctccctcccctccccctgaggaaacaatgcccttttgataataatttgctctctgcctgcctgacaagtactcagctgagatttctcagccaacaagacagtacaaacacttgcggtaccaagcaccactttctcaaaccctggcctcattgaggtgataacaactgtcctgctcaagggattccccctttccccctcttcctcactccttcccccacctcctcttggtgttatacagggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagt

SEQ ID NO: 197744 - DNA, 3138 bp, Homo sapiens
  Payload ID: 18994
  Gene Name: ubiquitin-fold modifier 1
  Uniprot ID: P61960
  ENST ID: ENST00000239878
  CDS Start-End: 40-297
cggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtatatattcatctgagataaaaatataaaaagaattatggaccctggatggcaatttgcttgatagcatctgatttgcagactcataatttgatttttaattaaatatataggttgtgatgaagtgaatagacatatcagtgaacagttaactatattaaatttttatcatttactttttttaagattcagacctcagttatataaatttcagtttaatatcaaccaaaaaattaaaattttaatctaacccttatgtgtataaattggtgtcccataccagcttttaatggtggacctatagaatccagtacttttaatggtgggaatttacagtagaagcatcctttgctgagttatacattcctttatcaatctcttttgatacaacatttaaaacaagtagcttcaagaaaccactggtgttttgaggatagtatttctaaatagcattcaggaacagagtattattgcacagatctgaagatcaaaaaaaagctcaaggaaatacagatcggaagtgctgatgagttatatttattgaaaacccaacttttaaggaagtgctaagatcagtcacccatgtgaataagaagccaggaaaggaaagatggggaagcccagatcaccaggcttctattaaggaggaaagcaacagaggaaacagtgaaggggaacagaagggggtagcaaagtgttacagaaaagcggactggatagacaaaactgcagaaggtgtatgttggggagaactgaaagggaaaacaaaatacttgacatagtcttaagtagaagaaggcagttagagaaaacaaagtatctactggccttgtcaacatacagacttcaaaataccccttatgagaatccaaagaatgatgtgtgtaagggaagattttatttgcccttccggaagaaatcagtatctatgcaaatcttgaaagacgaaatcaaagcccattaatgattcagaatcagtgcttgacctcctgtattctgaatggtgaactctggaagcagggattgtgtctggctctttttagagctggaaatgtagtggctttcattaaatacttgctgtaaagtctttctaagaccaattattatcttagcatgtttcagtatcttctctatcataggccctaagttcattgggggaaaaaaaataagaagattcaacagaatcagcatttgaagtgtaccattggtagttgtttatgaaattaccagatattcataaatgtgacaaatgaacagcaggattatgaattatcaaaggaaaaagtatttgctgaggtgaaaaaatctgatgtttgaggaagtttttatttttatttatttgttttgtttttttttttttgaggcagactctctgtcgccaggcttctcctgcctcagcctcacgagtagctgggactacaggcatgcaccaccacgcccagctaatttttgtatttttagcagagacagggaggaagtttttatttttataaacaaaatctgatgttcagaggccccgtttcttacaataaatgttgagtcttagttaagcaggaatttatgaacacccatttcctgactttttgctttaatttagatttttctccatcctgtttctagcacaaaaatttgcctgctgtgttacaaaaataaatttatgttgtcctgtgccataaagtgatatatttaatatttttattctttggttttgaacattgtaagttcctaaaaacattttattaaacaagtagacattttgttattaaaaaaatgtgatctgtaatttctttgtgcagaatgatttgaagtattgtattcagtttacatgcgttattggtttataattaatatctaatgaaaatacatgttgttatattgtaaaccatattgtctgttcttattattagagctcttaatcagcacaccttttgagtcagtatataatacatgtagtaaagaaaaaaagggcaaagatgattaatgaccataagtcagagaaattagtttatagtcatctgccacagacatagtagtgatgtttcgtccaacaacagaccgcatatatgaccgtggtcccatattactatatttttactgtgctttatctatgtttggatacacaagtacttaccatcattttacagttgtttacagtattaggtacagtaacatgctctacaggtttgtagcctaggagcaataggccataccaaatagcctaagtttgtagtaggtgacatcaactaggtttgtacaagtacattctgatgttcacatagtgacaaaattgcctaaggaagcatttctcagaatttgttcctgtgattcagtgatacataacagtacttgcaaatgcctgtccattttacagacggaaaaaaaaaaaaaaaaagttgagaagaaaatggggttattgtaactggctaggttggtaggttccaaacctgggtgataacagagtcgcctaggaaattaaaaatacagatttttggaaacca

SEQ ID NO: 197745 - DNA, 846 bp, Homo sapiens
  Payload ID: 18994
  Gene Name: ubiquitin-fold modifier 1
  Uniprot ID: P61960
  ENST ID: ENST00000379649
  CDS Start-End: 188-499
agcacactagaggaagtcgtgctacccccgcggagttgtcgtgtgttctggattcattccggcaccaccatgtcgaaggtttcctttaagatcacgctgacgtcggacccacggctgccgtacaaagtgtgagtagctcggccgagatgggccttttggggccggacaagacggggctgggttggggatgatccgagcttttccaacaactaccccacgcagtcttcatctcttcacttcatctactttcctggctcgcgcccttccaggagcctttcccaccggagcctgcgaggagagactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacaccaggagtcaatgattaatgaaaggtgactcatctgtccctttttgttgtccatactcttcctatgaagagggaatgcgtatgaattaaggctactactgtcacagaagatcatagtctttgatgctacctcacaacacaaacaggtagttcgttgggggcaaatgaattagccaactgttaactggaagcttttgataatttttttttttagaacaatttggaacattaaaatttactgaatcgtat

SEQ ID NO: 197746 - DNA, 639 bp, Homo sapiens
  Payload ID: 18994
  Gene Name: ubiquitin-fold modifier 1
  ENST ID: ENST00000437952
  CDS Start-End: 1-244
caggtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggtgagtatttgaaaactcatagaggagtgggtggggttatatatgtcaattgacactgaatagttaagctattctaattacacttgacagtattttaacataatggagctgttttttagggattatataccagtctttacctgtgtgtctgagtaataagttgtttcattgtgtatattgattgtagatgtttttggctacaagtaacagaaaacctaatagtggcttaagcattaagagtatttattatatataacaaaaagtctgtagataagattgctttctaattggagtattttttgacctacctcttaaggtagttgtgagatagtgactgtaaagtgcttcatagcttggattatttatagaaagcattcattaagtgctattattttttttaaatatagtcatttacatttcaaggggctgagtctacattcagatcttc

SEQ ID NO: 197747 - DNA, 1114 bp, Homo sapiens
  Payload ID: 18995
  Gene Name: ubiquitin-fold modifier conjugating enzyme 1
  Uniprot ID: Q9Y3C8
  ENST ID: ENST00000368003
  CDS Start-End: 247-750
accctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactagctcatctcatggctctggggctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttatatccgcccccaggtggagcaacatgcgattctggaggcacgggggtaactgaaagtgagtacatatagtctttctggtttctggagataacccatcaataaaagctgcttcctctggta

SEQ ID NO: 197748 - DNA, 4384 bp, Homo sapiens
  Payload ID: 18996
  Gene Name: ubiquitin-like 3
  Uniprot ID: O95164
  ENST ID: ENST00000380680
  CDS Start-End: 1147-1500
ggagggaggacgaggacgggggcggcggctgctgcgagggggggcccgtgctctccccgtttcccttagtcgcactcaggcagccgccgccgccgccgctgccgccatgttggtttgagaggcgatgacaggaggcggccgcggcgtgtgggactgaaaagtgaaggaggaggaggagaaacaaagctctgagaggaaaccattcccgggctgaggagaaggaggacccggcctcttccggggaccagccgaagtcggcgtcgcccggagctcgcgaggccggggaggggaggggaagggaaggcggagaccggggaggcggcggcggggaaggcggaggcagaagaggagtggcgaggagccggagacgatgcgccccgaccccagctgctgtccggaggcgcccgcggcctgagcccagaggggctgtggagtgtcccggccggccccgagcacccccgcgctgtcggtcccccgctccggtctttcgctttggcttccaactagttaaatgcccttgagcgcgggtttccgcggcccggctcttcgcccccgcggcgcgagttgagccgtttccccgcgctgtccgcgcgggcgctccgacagcggctctgcagggtccgcggccagcgtccggccaccgctcggccgccactcaaggctcacgcgtcgatgtgtagctacatagttatctgtgtacatccacgctggggcatttttctcctgcttaatgaggacttgactcgggagcaagtgtgaatcattgccggggctgggaaaggaggaaggcgcatttaaccccctcccacccctctccatgtccgtgtgtcactcggctcggtccacctggcgcggccggtcctggggctgctgctgctgttgacgacgacgacgacgacgggggctgcctctgctgtcccgggagtttcctcctgctccggccacacagctcctggggattgttcctcttcgaaccagaacctcggcctgaccggcactttggctccaaaataactttatttttgggggagaaagcacatcacgaaccagtcaaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaggtcagaggaatcgtgagaagactggagagagtaattgttgtgtaatcctgtaaacactgtctgcctagtgtgatgtgatatagtctttgtctttcatgctgctgggacagaaaagacccgacattgcttcagaaaccgttcagaacagtctgcctgtaaacacatggaactgaattaccacatgaacactgtcatcttttctcatgaaagtaaaaagaaccaagaacatttttcactctgattttttatttcttgtattttttgttgagctgttttaacacatattggtttttgaatgcagtcaatctccaggggaaaagttaacaagttatctttcgtagcagaaaccattttgctgccacaaaattttcatcatcagaactaataaatcaagtgttccaaatacaatttgcattaaaaagattggcattattttcctcatcagcagaatttataacagtgtgtggtatctagaaatacttatatatacaattccacactggaagacactcagcaattaatgaagttaattactgggccaacttgagaggaaaaaatggaaaagaaactaaaatgttgggtgaattctaccaaagtcagccgtggtggctgcactggcacagaatactaaactgagtgtgactattttcactgcaacaaatgaaaaaacaaaatgtgcctgtttaaagcactcagtagagggctgatgaaactaattttttttcctttaagacatgcactcttgagtcctacagtaactgagtgtttgtttagacagcacaagaaggggtgagagtgcgtctcctagccttaatgtgggagggtagtttcagtcactcatcggctttcattattgtgcagaaatattagaaaacctcattgatcaattttatgtatttgaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatacagaacaatattccatataaataagtttagcctttataaaaatgaagttgcaggctgacattacattctgtactaagtgtcaacagcccttacaaacattaaatgtaaatggtttcaaatggtcagcgttgtttaaatgtaatcatgttattttattcattgttaatgctttgatgaaaaggctttatatgcagtagatctacgaaaatattgttcatactgatcagaattaaatttgtatagagcagagttttaaaatgaatgtaaatagcactaaacgttttctttctgcaacctgtacttacagattcttcctgtaaactaaataaaaaaaaaatgatagtgcattttggtggtaattttaaaggtcttgattaggtcaataattgtttaagcaccgtctcattcatgttttctactttcatttcttaagcttttaaaattcatttaattaatattctgttgttgttttggggagtattcccaatgtatctttgatatttaacctggttaatttgtggacagtcacaacaatggatagaattatgtagtctccgttatcactaaaatgttatcttcaagagatgttaaatatttatatgctttgttgactagctgaaatgtgaattctgttagtgttgactaaagaatctggtagttgcttaattgggcaattaaacaatttatggctctattttgtaaaacaaactactggtaattatttttaatacctattttcattctgattactctttttttaagttaaagactatcagttaattaagattgagtttttatgatggttaaaaataattctctattggtttttcaatatatttttctgtgtgttctcagattatatatttccctcaatttagagtttgctaagtgaaataaactggttcactagtagagaaagaattacgtcgcttaatacctaatatcatagttgtacaatatgaaaaaaaagaataaaaagtagcagtaaaattatatactgaaaacaccaaaaatttagatgccttaatagtatatacgtgaaatactcagctgtccctttaaaaataattccttggactgcctggtggttaaaatacgattcctcatatccaaggctacttttgaagatccctctgccaaaaatatagctcacttatctaaaggtgagagctgcatagatccagtaatgtacataaagcctgaatgatgagcctatgtccctgcctaacgctggtgtctcactcatctcttttacctaaattgtcctgaactttgttaagtgttctggacaaggccaagcttttctttattaaaacctcagcatgtctccctgatctgaactatttgctttctcttcaagataagttgtattttaccatggaaaaatacagtatctaacattaccattcacgttaaatgaagtttcctcataacatttatctttagttttatgaagtcatcgtgaccaatgttacagtaatttctgttagctgattgtggtaaacaatgtttaatgtgaaaagaaattaaaactttcttcatctgttgtagaatatttctcttctttaaaatggcttctattcataa

SEQ ID NO: 197749 - DNA, 711 bp, Homo sapiens
  Payload ID: 18997
  Gene Name: ubiquitin-like 4A
  ENST ID: ENST00000369653
  CDS Start-End: 32-574
gccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacgttgggctcatcatcatcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctc

SEQ ID NO: 197750 - DNA, 2382 bp, Homo sapiens
  Payload ID: 18997
  Gene Name: ubiquitin-like 4A
  Uniprot ID: P11441
  ENST ID: ENST00000369660
  CDS Start-End: 87-560
ggttccagcgcgcgcccggggcggcggcgcgcggcggggggtggttggggtgcgcgccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcatcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccaagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagtgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatggactgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtcagaa

SEQ ID NO: 197751 - DNA, 1652 bp, Homo sapiens
  Payload ID: 18997
  Gene Name: ubiquitin-like 4A
  ENST ID: ENST00000421431
  CDS Start-End: 29-130
ggcccgagtggacgccgtcgcgaccgccatgcagctgacggtgaaggcgctgcagggccgcgagtgcagcctgcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcatcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccaagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagtgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatggactgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatggg

SEQ ID NO: 197752 - DNA, 743 bp, Homo sapiens
  Payload ID: 18997
  Gene Name: ubiquitin-like 4A
  ENST ID: ENST00000417913
  CDS Start-End: 3-314
ccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagccggatgccgcagcgctccgctcccgccgcccgaggcggcctcgcgccccgggccacccccacggcggtggaggaggaggaacccatcgatctgtctttggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcatcatagctggcatgtacctggctctggccaggtgctaggcactcctcacagcttgacctgggtttgcttcca

SEQ ID NO: 197753 - DNA, 102 bp, Homo sapiens
  Payload ID: 18997
  Gene Name: ubiquitin-like 4A
  ENST ID: ENST00000630530
  CDS Start-End: 1-102
atgcagctgacggtgaaggcgctgcagggccgcgagtgcagcctgcagatgggaaacgactctcggattatagcatcgggcccaactccaagctcaacctag

SEQ ID NO: 197754 - DNA, 1478 bp, Homo sapiens
  Payload ID: 18998
  Gene Name: ubiquitin-like 4B
  Uniprot ID: Q8N7F7
  ENST ID: ENST00000334179
  CDS Start-End: 68-592
ccgcaggaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgaggagcgcctgcagaagataagcctggagcacctggagcagctggcccagtacctcctggcagaggagcctcacgtggagccagctggagagagggagcttgaggcgaaggcacggcctcagagctcctgtgacatggaggagaaggaggaggcagcagctgatcagtaaacgggccatcctacccatttgcatgctaaaattctcccggcctcatccttacgtgttccctggtgacttttcctactacttcctgctgatgtggatgcgtccacacccctttttgaaccttccaagcagctggagggtttttggatccctgtcccctcttgggcctgaggtcctccctctgaaatgcagagtgaaccaaccctcatcaccatgcttcccctagaagggttctgatcaccggagggcagccccaaaggccacagtcccctcctgtgctggcagctttgcccacacatacccagcagctccccaggctgaaagcagccctggcccagggtctccatggttctaggcagaccctctttctccttcgggacagaaagacaatgtgagttcattttcctccatcctcagaccgtgacatctcccctaggctccccagcagccaagaggagaggaatgtcaggtagctgccccttgccttctgggtgaggctgcccctgctgttctcctgcttgtgcttccagcttaagggacaggcacagcagaggtgagagtgggaggagggcacgtaccgggtgccagccctggagccctcagggagacagacacagaccaagaatagcaggaaactgagcctcaggcagaaaaaaagttcagcaaagtcatacactccctgtggccagcgtgaacagagccatgccccaccctcccagactgatcagtcagtaggtatcacagctcacattacctgcccagcgctgcccaaggctccctggaaggaaaaatggtatctgtcaatgaggatccttgccctcacagagcacgcagcctagatgcagagagctgctatacatgtgaaaagtaaagtggtgacatgaaacta

SEQ ID NO: 197755 - DNA, 513 bp, Homo sapiens
  Payload ID: 18999
  Gene Name: ubiquitin-like 5
  Uniprot ID: Q9BZL1
  ENST ID: ENST00000358666
  CDS Start-End: 185-406
aacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 197756 - DNA, 390 bp, Homo sapiens
  Payload ID: 18999
  Gene Name: ubiquitin-like 5
  Uniprot ID: Q9BZL1
  ENST ID: ENST00000590068
  CDS Start-End: 62-283
cttccgcttccggttcctagcgttaactgcgaccggggttcagcgctcggctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 197757 - DNA, 320 bp, Homo sapiens
  Payload ID: 18999
  Gene Name: ubiquitin-like 5
  ENST ID: ENST00000593087
  CDS Start-End: 82-192
gttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgt

SEQ ID NO: 197758 - DNA, 432 bp, Homo sapiens
  Payload ID: 18999
  Gene Name: ubiquitin-like 5
  Uniprot ID: Q9BZL1
  ENST ID: ENST00000586895
  CDS Start-End: 105-326
aacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgtt

SEQ ID NO: 197759 - DNA, 1360 bp, Homo sapiens
  Payload ID: 19000
  Gene Name: ubiquitin-like 7
  Uniprot ID: Q96S82
  ENST ID: ENST00000361351
  CDS Start-End: 105-1247
tccggtttccggcgagagggccagagtgagtgtttacaccggcggcagtgcggccgggttccttccgcgggacggggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 197760 - DNA, 1427 bp, Homo sapiens
  Payload ID: 19000
  Gene Name: ubiquitin-like 7
  Uniprot ID: Q96S82
  ENST ID: ENST00000395081
  CDS Start-End: 172-1314
gtttccggcgagagggccagagtgagtgtttacaccggcggcagtgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 197761 - DNA, 1477 bp, Homo sapiens
  Payload ID: 19000
  Gene Name: ubiquitin-like 7
  Uniprot ID: Q96S82
  ENST ID: ENST00000564488
  CDS Start-End: 223-1365
ccgcgggacgggtgagggcgctggggccctgggcagcgcgggctcgatgtgtgtcagccaagtagctggtcccactggagcgaggtctctttggaagcaataatgatgactataacaagaacttatcttgctttgcaagattcttccgccgtcagagtttctgatttattttctggggttccatgtatgccagggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactct

SEQ ID NO: 197762 - DNA, 458 bp, Homo sapiens
  Payload ID: 19000
  Gene Name: ubiquitin-like 7
  ENST ID: ENST00000565494
  CDS Start-End: 1-345
ccagcctccctggggtacagtggagctgctgggccccggcccatcacccagagtgagctggccaccgccttggccctggccagcactccggagagcagctctcacacaccgactcctggcacccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 197763 - DNA, 661 bp, Homo sapiens
  Payload ID: 19000
  Gene Name: ubiquitin-like 7
  ENST ID: ENST00000566365
  CDS Start-End: 1-548
aacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 197764 - DNA, 1720 bp, Homo sapiens
  Payload ID: 19000
  Gene Name: ubiquitin-like 7
  Uniprot ID: Q96S82
  ENST ID: ENST00000567435
  CDS Start-End: 465-1607
ggcgctggggccctgggcagcgcgggctcgatgtgtgtcagccaagtagctggtcccactggagcggtgaggtcgccaccggatagtgttcctgccccattactagcgatctgtgaccttgggccagtgattttactgagtcttgcttccctcatctttaaaatgtggctaatgcctgccttagggaaccgttgtgaggattaagtgagacatggtatataaaacgacctccttctggcataaacttgaggtggaagataccttgaggatgcttgaaggtctgctaggcagcttcacagccttttctttcctcttctctatcagaggtctctttggaagcaataatgatgactataacaagaacttatcttgctttgcaagattcttccgccgtcagagtttctgatttattttctggggttccatgtatgccagggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 197765 - DNA, 1414 bp, Homo sapiens
  Payload ID: 19000
  Gene Name: ubiquitin-like 7
  Uniprot ID: Q96S82
  ENST ID: ENST00000565335
  CDS Start-End: 159-1301
gtttacaccggcggcagtgcggccgggttccttccgcgggacggggatgaagaaactgaggcctagagagctgtccatcacagtatgagtagagagagaaccccagattctagttctggcctcctgatgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggtctttaagatgctcagcaataaggagtctctggatcagatcattgtggccaccccaggcctcagcagtgaccctattgctcttggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcactccggagagcagctctcacacaccgactcctggcacccagggtcattcctcagggacctcaccaatgtcctctggtgtccagtcagggacgcccatcaccaatgatctcttcagccaagccctacagcatgcccttcaggcctctgggcagcccagccttcagagccagtggcagccccagctgcagcagctacgtgacatgggcatccaggacgatgagctgagcctgcgggccctgcaggccaccggtggggacatccaagcagccctggagctcatctttgctggaggagccccatgaactccctgcttcccctgaacccccagcaagttgcagaggctactgcccttgggaggcactcatgaaggtgcctccatctctcccttccccaatatacctgatggtcaactctc

SEQ ID NO: 197766 - DNA, 792 bp, Homo sapiens
  Payload ID: 19000
  Gene Name: ubiquitin-like 7
  ENST ID: ENST00000565130
  CDS Start-End: 119-792
gttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccgggggttctccaggacaaggacctcttctctgtcttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggctctcagatgatgaggatgactttcacccaaacaccaggtccacaccctctagcagtactcccagctcccgcccagcctccctggggtacagtggagctgctgggccccggcccatcacccagagtgagctggccaccgccttggccctggccagcac

SEQ ID NO: 197767 - DNA, 621 bp, Homo sapiens
  Payload ID: 19000
  Gene Name: ubiquitin-like 7
  ENST ID: ENST00000563081
  CDS Start-End: 135-621
gcggcagtgcggccgggttccttccgcgggacgggtgagggcgctggggccctgggcagcgcgggctcgatgtgtgtcagccaagtagctggtcccactggagcgggagaaagagagagcgcgaaagagagaggatgtctctctcagactggcacctggcggtgaagctggctgaccagccacttactccaaagtctattcttcggttgccagagacagaactgggagaatactcgctagggggctatagtatttcatttctgaagcagcttattgctggcaaactccaggagtctgttccagaccctgagctgattgatctgatctactgtggtcggaagctaaaagatgaccagacacttgacttctatggcattcaacctgggtccactgtccatgttctgcgaaagtcctggcctgaacctgatcagaaaccggaacctgtggacaaagtggctgccatgagagagttccgggtgttgcacactgccctgcacagcagctcctcttacagggaggcggggttctccaggacaaggacctcttctctgtcttcgctgatcccaatatgcttgatacgttggtgcctgctcacccagccctcgtcaatgccattgtcct

SEQ ID NO: 197768 - DNA, 2392 bp, Homo sapiens
  Payload ID: 19001
  Gene Name: ubiquitin-like domain containing CTD phosphatase 1
  Uniprot ID: Q8WVY7
  ENST ID: ENST00000296786
  CDS Start-End: 327-1283
agagcggccacccagggatcggcgctatctgcacagcggttacagtctcggaaaggcctggcttcttcgtggctttgtggagatcccttacagcggccatttgattagcacccgaagagattcaaaggaagcagttgttccgtccccaacatatttccgtttcaaaccacccacttccggtttttcagccggttccggtcccgcccttcacttccggtcgctttcggtctctcagcggccggtttctgcgtccgctgccgcaggttccaccgcgctccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggcaaacctgcagaaaatgatgttaagcttggagctctcaaactgaaaccaaatactaaaatcatgatgatgggaactcgtgaggagagcttggaagatgtcttaggtccaccccctgacaatgatgatgttgttaatgactttgatattgaagatgaagtagttgaagtagaaaatagggaagaaaacctactgaaaatttctcgcagagtgaaagagtacaaagtggaaattttgaatcctcccagggaagggaaaaagcttttggtgctagatgttgattatacattatttgaccacaggtcttgtgcagagactggggtagaattaatgcggccatatcttcatgaatttctaacatctgcctatgaagattatgacattgttatttggtctgcaacaaatatgaagtggattgaagctaaaatgaaagagctgggagtgagcacaaatgcaaattataagattactttcatgttggatagtgctgctatgataacagtacatactccaaggagaggattaatagacgtaaagcctcttggtgttatatggggaaagttttcggagttttacagcaagaaaaacaccattatgtttgatgacatagggagaaattttctaatgaacccacagaatggactaaagataaggccttttatgaaagcgcacctaaatcgtgataaagacaaagaacttttaaaattaactcagtacctcaaggagatagcaaaattagatgactttttggatctaaatcacaaatattgggaaagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttctaaattctgagcggtctcagttaggcctgtatgtgtgtacatgtccaagtaaagctggaaaatgtcagtcttgacacagctgtgtcttagtatgagaaacagaagactgaagaataaaaactaaggaacaagaatgagtctctttttggtggctaagtagaatcttcctaaaaccattgtcataaaagcagttaaaggcaataaatttttaaaagggacatatcactgattcattcctaaaaagcatgaacaaaaagtttttgttctgttccagctatatcttgtctaagtgctaacactgtttcagtgaaaatatctagccataagattaaaaaaatatattatttgcaatgcttaagcctgcagatacgtaatgtgaccactgttttgtgttgacaatattgctttatacagttcttgtatttgaaaggaattgatccttttaaagaaacatggtgtatattgttcttacaggactaatttcagtggtgtaaataataaatatcttttcttaaaacatt

SEQ ID NO: 197769 - DNA, 3559 bp, Homo sapiens
  Payload ID: 19002
  Gene Name: ubiquitin-like modifier activating enzyme 1
  Uniprot ID: P22314
  ENST ID: ENST00000335972
  CDS Start-End: 184-3360
ggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattgatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactccca

SEQ ID NO: 197770 - DNA, 2497 bp, Homo sapiens
  Payload ID: 19002
  Gene Name: ubiquitin-like modifier activating enzyme 1
  ENST ID: ENST00000377269
  CDS Start-End: 780-2300
ctaattgaagtttttattttttatggaggcataacatatctagaataaggtacacagatttttttttttttttttttgaggtggagttttgctcatgttgcccaggttggagtgcagtggcgcagtctcggctcactgcagcctccgcctcccaggttcaagcgattctcctgcctcagccttccaaagtgctgggaatacaggcgtgagccacctcgcctggcactcagatcttaatacatttttaggctgggcatggcggctgacacctataatctcagcactcaggaggccaaggagtgaggtttgtttgagcccaggagttcaagaccagcctaggcaacatagcaagaccctgtctctacaacaaatcttaaaaattagccgggtgtggtggcatgtgcctgctgtcccagctattcgggaggctgaggtgggaggatcgtttcaacctgggaggtcaaggctgctgtgagccgtgattgcatcgctgcactccagctcgggtgacagtgtgagactttgtctcaaacaacaaaacaaaacagttttccacatacacagcactattgtaaccactgcccaaatcaacttcattgatttttctttttttgagacagtcttcctctgtcacccaggctggagtgcaatggcatgatctcggctcactgcaacctccgcctcccgggttcaagagatttcctgcctcagcctcctgagtagctgggattacaggcatctgccaccacgcccagctactttttgtatttttagtagagatggggtttcaccatgttggtcaggctggtctcgaacccttgacctcaggtgatccatctgccttagcctcccaaagtgctgggattacaggtgtgagctactgtgcctggcctggtttttcaattgaggtgggggaatggggaaggctagagggcttccccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcc

SEQ ID NO: 197771 - DNA, 3466 bp, Homo sapiens
  Payload ID: 19002
  Gene Name: ubiquitin-like modifier activating enzyme 1
  Uniprot ID: P22314
  ENST ID: ENST00000377351
  CDS Start-End: 91-3267
cttgtacgacagaggtggtttgctcttccgttgccccgtggcttcagctcatctttggcaggaaggcgaggcttccgcccggcacaggggatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactccca

SEQ ID NO: 197772 - DNA, 1054 bp, Homo sapiens
  Payload ID: 19002
  Gene Name: ubiquitin-like modifier activating enzyme 1
  ENST ID: ENST00000442035
  CDS Start-End: 202-1054
atcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgg

SEQ ID NO: 197773 - DNA, 671 bp, Homo sapiens
  Payload ID: 19002
  Gene Name: ubiquitin-like modifier activating enzyme 1
  ENST ID: ENST00000427561
  CDS Start-End: 151-671
aggactgcgagactggacacgtcgggggcccagatgtttctagggagaggagcctcccagctcaggctagggaagggacaccggagcccagctcttcctgagctgacgaggcgccacccggcctttattcattattcataataaggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttcca

SEQ ID NO: 197774 - DNA, 1706 bp, Homo sapiens
  Payload ID: 19002
  Gene Name: ubiquitin-like modifier activating enzyme 1
  ENST ID: ENST00000451702
  CDS Start-End: 1005-1706
tgggccctgagcccaggggcatttggcaaacagtcccccaccagctgcatgcctctgggcgagtgaatggggttctctaagcctttcttttcccatttgtgatttgggcatagggttatctgggtcatggggattgttaagattagacaaagccctttcctctttgattgacacacagtatgctcttggtagatagtagggagctcttgtcattgtggttggtgctagtgacaagtgccaagatggaatcttaggtacattgggatacttagtgtcataaaagtctcagtgtgggaggacttgtgtgaacagaagactcagtgcctagaggagcacttggggtgaggggaagtgacgctgggtcctcccatctccagcatgtggacccagtcacccccaccaccagatttcacttccacagcaggctttattgttctgtctctgggacctagcaggtgaccctgggcaagttacttctcatttgtccggcaaggacactaaactctgccttgctgggtcagggtcatggaggggatgaaacgtgataacacgaggaagcagcctgggcttcagagtcagcagatcctggtctggtcccagctcagtgtgtgggaaccttggtcaccgaacgtccctgagtgaatttttttccatcactttaaagttgggggtattattgatagcagtccaaaccccacaggagtaccctgaggacagagtgagacgaggtttagagaagtgcttactatggcatctggcacaaggaggactcctgatcaatctaatactcatttatcattgtggttaacctgtttaagggactccgcatgcagatgaggcttgggatgtgtttgttttctatctttttgcaacctcttttattggtctgtgtcggttttcccctcccaaagctgggggcagggttgggctttataaaacttgagcccctctggggactgggttctcagcaagttaccgctcctgccatcatgccaccctgatggatgtccaagcctcacttccctcctgcactccccgctcccgccgccatccctgggattaagggagaggagaatggctgcttgttactgcctacctactctgtgccaggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggc

SEQ ID NO: 197775 - DNA, 809 bp, Homo sapiens
  Payload ID: 19002
  Gene Name: ubiquitin-like modifier activating enzyme 1
  ENST ID: ENST00000457753
  CDS Start-End: 225-809
tcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattgcaagttaccgctcctgccatcatgccaccctgatggatgtccaagcctcacttccctcctgcactccccgctcccgccgccatccctgggattaagggagaggagaatggctgcttgttactgcctacctactctgtgccaggttctatgctctgtgttatttatcatctcgataaccccgtggggaagatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtc

SEQ ID NO: 197776 - DNA, 1148 bp, Homo sapiens
  Payload ID: 19002
  Gene Name: ubiquitin-like modifier activating enzyme 1
  ENST ID: ENST00000412206
  CDS Start-End: 337-1148
ggtcctccccgcgcctggaggctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaagggacgtgctgaaggggcgttctgaagtctgccgcgcaaacgagttcattgatgattcgcaaaaatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctggg

SEQ ID NO: 197777 - DNA, 4023 bp, Homo sapiens
  Payload ID: 19003
  Gene Name: ubiquitin-like modifier activating enzyme 2
  Uniprot ID: Q9UBT2
  ENST ID: ENST00000246548
  CDS Start-End: 71-1993
ccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacacatgcctgcacagttcctgtttctgctgccttatatctactgcaggaatgtcaaattcttttcattaaaaaaagaactcggtcgggcacggtggctcatgcctgtaatcccagcactttggaaggctgaggcaggtggatcacctgaggtcagtagttcaagaccaacctggtcaacatggtgaaaccccatctctactaaaaaaaaaaaaaaaaattagccgggcctggtggcaggcacctgtaattccagctactcaggaggctaaggcagcagaattgcttgaacccgggaggcagaggttgcagtgagccaagattgtgctattgctactccagccagggcgatgagtgaaactccatctcaaaaaaggttcagaagatctccactgtttgccaaagacgagtactttcttttctttattcttggagacttcacatgtaggaagagtactttctaaaataaagctcttcctgcgtgtggtggtggtgcacatctgtgttccagctactcaggaggctgaggcaggaggatggctggagcccagaagttcaaggccagcctgggtaacatagcaagaccctgtctctaaaaaataagtaaataaaataaagcttttaatggcagtgggttttttgttcgtttttgagatgaagcctcacactgtcatctggcctggagtgcagtggcgcgatcctggctcactgcagcctccgccttccaggtgcaagcgattctcctgtctcagcctcccctgtagctgggattacaggcgccctccaccacgctcagctaattttttgtatttttagtagagatggggtttcactatgttggccaggctggtctggaactcctgacctcgtgatccacctgcctcagcctcccaaagtgctgggattacaggcgtgagccactgcgcctggcctaatggcagtgtttttaaaatttggattgtcagcagttggcctttgttgagaaaatgtgtgactttgcccaagcccagtaacttggagccttgaatttgagatgctggaaagggagtccttcctcctttctgcagtgtttgtctgggttgtcccctagtttaccaaagtccattttgaatgtaccatccccagcccaactccagcctacagatagtgccagaccgccagtaggtggagtagcactgtcttcctggtcccggacctcagagggctttgcctgttagggtactcttatcactcagagatgggccttgagttttcagagaacagaaagccattaagctgtttcccctattgtattcatgtgccctttgtgtttctggcaataatttattttatatttcaactaaattttaaatttctaattca

SEQ ID NO: 197778 - DNA, 2802 bp, Homo sapiens
  Payload ID: 19003
  Gene Name: ubiquitin-like modifier activating enzyme 2
  Uniprot ID: Q9UBT2
  ENST ID: ENST00000439527
  CDS Start-End: 499-2133
aaaacaaattcccggctgttaggagatgcgggagaggattgagtccctcgcggatgttgtgactttaattttgaggtccctgtcgtaactccgaagtaacgacgcggggcggaggatggcaatgatagcgaccaacgcgtcccgagcgctggtcacgagcgggtttacacacggaacgcgcaccatcttcataccacccgaggagtgcaaacgctatttccaccctgctttatttttaacagatgaggaaagggagacgcaatggggttgagtaacttaccctgggtcacggagcgagtggcagggctcccgcaggctgcgtgactgtcattgctctcacagtagacgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtt

SEQ ID NO: 197779 - DNA, 847 bp, Homo sapiens
  Payload ID: 19003
  Gene Name: ubiquitin-like modifier activating enzyme 2
  ENST ID: ENST00000590048
  CDS Start-End: 61-847
ttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaag

SEQ ID NO: 197780 - DNA, 1458 bp, Homo sapiens
  Payload ID: 19003
  Gene Name: ubiquitin-like modifier activating enzyme 2
  ENST ID: ENST00000586313
  CDS Start-End: 75-299
cttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatag

SEQ ID NO: 197781 - DNA, 646 bp, Homo sapiens
  Payload ID: 19003
  Gene Name: ubiquitin-like modifier activating enzyme 2
  ENST ID: ENST00000591016
  CDS Start-End: 1-646
ggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaa

SEQ ID NO: 197782 - DNA, 754 bp, Homo sapiens
  Payload ID: 19003
  Gene Name: ubiquitin-like modifier activating enzyme 2
  ENST ID: ENST00000607361
  CDS Start-End: 82-246
ggccgcccttcccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgccaccagggtctcactattttgcttaggctggtcttgaaggtctgggctcaagcgattctctcactttgtcctcccaaagtgttgggattacagattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttc

SEQ ID NO: 197783 - DNA, 910 bp, Homo sapiens
  Payload ID: 19003
  Gene Name: ubiquitin-like modifier activating enzyme 2
  ENST ID: ENST00000592791
  CDS Start-End: 233-733
ggcgtataaaattacagcacgtttccgatttctgcctgttatttctcctccaaagatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtatt

SEQ ID NO: 197784 - DNA, 2112 bp, Homo sapiens
  Payload ID: 19004
  Gene Name: ubiquitin-like modifier activating enzyme 3
  Uniprot ID: Q8TBC4
  ENST ID: ENST00000349511
  CDS Start-End: 56-1405
cccgctcctccccgccctgccgcgcgtgggcacctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 197785 - DNA, 2154 bp, Homo sapiens
  Payload ID: 19004
  Gene Name: ubiquitin-like modifier activating enzyme 3
  Uniprot ID: Q8TBC4
  ENST ID: ENST00000361055
  CDS Start-End: 56-1447
cccgctcctccccgccctgccgcgcgtgggcacctgggaagaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 197786 - DNA, 2004 bp, Homo sapiens
  Payload ID: 19004
  Gene Name: ubiquitin-like modifier activating enzyme 3
  ENST ID: ENST00000415609
  CDS Start-End: 29-1297
gggcacctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaagccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 197787 - DNA, 1224 bp, Homo sapiens
  Payload ID: 19004
  Gene Name: ubiquitin-like modifier activating enzyme 3
  ENST ID: ENST00000461934
  CDS Start-End: 25-219
acctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaaaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaacttt

SEQ ID NO: 197788 - DNA, 1388 bp, Homo sapiens
  Payload ID: 19004
  Gene Name: ubiquitin-like modifier activating enzyme 3
  ENST ID: ENST00000465627
  CDS Start-End: 25-414
acctgggaagaggcggagaacaatatggcggatggcgaggagccaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttagaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaacttt

SEQ ID NO: 197789 - DNA, 123 bp, Homo sapiens
  Payload ID: 19004
  Gene Name: ubiquitin-like modifier activating enzyme 3
  ENST ID: ENST00000631029
  CDS Start-End: 1-123
ctgatagtgtctatcttaaggctggaatgcaatggtgtgatcttggctcatggtaacctctgcctcccaggatcaagtgattctcctgcctcagcctcccaagtagctgggatgacaggcgcc

SEQ ID NO: 197790 - DNA, 390 bp, Homo sapiens
  Payload ID: 19004
  Gene Name: ubiquitin-like modifier activating enzyme 3
  ENST ID: ENST00000630585
  CDS Start-End: 1-390
atggcggatggcgaggagccaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttagaatttcatattattgtatgtggactggactctatcatcgccagaagatggataaatggcatgctgatatctcttctaaattatga

SEQ ID NO: 197791 - DNA, 2850 bp, Homo sapiens
  Payload ID: 19005
  Gene Name: ubiquitin-like modifier activating enzyme 5
  Uniprot ID: Q9GZZ9
  ENST ID: ENST00000264991
  CDS Start-End: 233-1279
gaggtgataagatagcatctgctgtggccaggcatccctgacacctgacaagaaagtaaagccaaaagtcagctgaagataatggccatggagatgtctgtggagagccgtaaaagccaatcatggctgagatgcctgcagaatctctgcccatgagaactctgaggcctcctttcctttggctgtggtaagccctctgggaaaagagcagctacccaccaccagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatttagcttattgaactgtaaaatagcttttctagtatgagagatgttttgaatttaaaaaatgaaatgcagtttttcaaaaataaatttcctttggaaattcttgcatatcaatttagtaaggttttataaaattttacaatttgataaagtatc

SEQ ID NO: 197792 - DNA, 3705 bp, Homo sapiens
  Payload ID: 19005
  Gene Name: ubiquitin-like modifier activating enzyme 5
  Uniprot ID: Q9GZZ9
  ENST ID: ENST00000356232
  CDS Start-End: 1073-2287
atgcctgtagggtgcgtccactgactgcaggaaaagcaatcagggtgggagaaacttaggaaaccacccagggccaaaggaaggaaaactcaatgtacaaatttttttccgctggaggcaaaggctgacatccatacctgtactgggcaatggtcagcgtagcctcacgttcggccccaaagccagacaagtgctggtttaggtaggcctccagggacttgctgtcgaacttgtgctggggcagcacttcggccaaatcggactcgccagtagcacctggcttcatgatcacccccgcaggccacagcaacgcggcatccacaggtctcgagtgccgaagtccttcaggattggggcaacgtcccctctagagcatgggccgaggccggggtggggtctggctccagccaaccgcacacagcctacgcgccgttgctgagcaacgcttgcccgctgaatcccgaggttttagctctagtcaagtgccaaaagagcccaatgtgtgttcgggtttcaattctccagtcagcgtcagagttggaggcctcaattttaaagaaggcaaagccatggtcatcgttgcgggtaaggaacaacgcagaagcctcttccacccccaaatttaatgcaacagcaggcggaagacctgcagggtcccgttcagaaaaagggccgtcagactgtcgagcctaagaataaaaagaccctgtttctcttagatacccggttagcaaggcaacatcgctggcctcctgccctggacacttatcaccccggtgctgctgcggccgggtttagccggcccagcgaggaaggaagccgaaagagccaggtttttgatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcattttttaaaaatt

SEQ ID NO: 197793 - DNA, 2058 bp, Homo sapiens
  Payload ID: 19005
  Gene Name: ubiquitin-like modifier activating enzyme 5
  ENST ID: ENST00000493720
  CDS Start-End: 593-1726
aagtgccaaaagagcccaatgtgtgttcgggtttcaattctccagtcagcgtcagagttggaggcctcaattttaaagaaggcaaagccatggtcatcgttgcgggtaaggaacaacgcagaagcctcttccacccccaaatttaatgcaacagcaggcggaagacctgcagggtcccgttcagaaaaagggccgtcagactgtcgagcctaagaataaaaagaccctgtttctcttagatacccggttagcaaggcaacatcgctggcctcctgccctggacacttatcaccccggtgctgctgcggccgggtttagccggcccagcgaggaaggaagccgaaagagccaggtttttgatgagggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaataga

SEQ ID NO: 197794 - DNA, 417 bp, Homo sapiens
  Payload ID: 19005
  Gene Name: ubiquitin-like modifier activating enzyme 5
  ENST ID: ENST00000489361
  CDS Start-End: 92-417
attttctgtgatgatgtatgtctatttgtattactaatacctaaaagactgtaagctttaaaacatatttttctttgttttaagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataag

SEQ ID NO: 197795 - DNA, 662 bp, Homo sapiens
  Payload ID: 19005
  Gene Name: ubiquitin-like modifier activating enzyme 5
  ENST ID: ENST00000468022
  CDS Start-End: 424-662
ggggagcgatgtctgcgacgcaccggaagcggctccgaggaaggcctgtgggagtctcggagacgtgtctgtctgtgaggcgctgggtgcacgtccccagggctctgggctaggaaggcagcggcgaggtgcctccccacgtacccctcgcgggcccagccgagcaacgagaggagtctgcaggtcccgaggagcggcgacggagggggcggccgggtccgcatcgagaagatgagctcagaggtggtggattcgaatccctacagtgagtcagccatatggtgctgctcctgtgcctgctgaggacgtgtgtccagtttcctatcacccttgcctcttaattagtccgcctcgctgtgtataagactgatagtaagaactttcagaagatgagatcaaatattaaacctgctaagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgag

SEQ ID NO: 197796 - DNA, 2997 bp, Homo sapiens
  Payload ID: 19005
  Gene Name: ubiquitin-like modifier activating enzyme 5
  Uniprot ID: Q9GZZ9
  ENST ID: ENST00000494238
  CDS Start-End: 695-1741
agtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacaggtaacctgcgtcgccggtcggaggcaggcgcgggggacgaggtcaggctccgtgaggtcagaagtgaggcgcttcccacgtcccgctcatggggacgcccgccacccttttcttggtctgcgaatcctgttcccaaatgggcaaggccacatcttagtactgatcggaagatattctttctcttttttaaaaacctccagtgagtcagccatatggtgctgctcctgtgcctgctgaggacgtgtgtccagtttcctatcacccttgcctcttaattagtccgcctcgctgtgtataagactgatagtaagaactttcagaagatgagatcaaatattaaacctgctaagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatggggtattgagctggtatctgaggtttcagaagaggaactgaaaaatttttcaggtccagttccagacttacctgaaggaattacagtggcatacacaattccaaaaaagcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatattgtaggatataaatcttacttgaaaacatagctgttgaaatgttttggccttttggagtgggggaaggacaaatctgatcctgtaatctttttctttccagtaatcccttgtgtctgttgcatgaggacatggacaataaagtagtatatgatcctcagatacagggagaaggacaaggcatacagcttattgattagagctggcaagcatctgctcattatgtttggaattgctttctataagaaaattgcccactactactaacttgatcaacaatgaattcaaaatagttaacctatgaaataacatcctctcaaatgtttgctgatgaagtacaagttgaaatgtagttattggaaaagtctgtaacctgtggatcatatatattcaaagtgagacaaaggcaaataaaaagcagctattttcatgaatagacaaagttgatttcaggaagtataaattatattctgcaccgaacaaggaacagaaattattgcatctgtggaacatatatctggagttactatactttactgaagagcaaggcataaatttagactaaaatccatccagattacactcattctttaggctactcctggatacttcatttaaatttgattttcgaggtagtgagatgtcggcaaggtttgtcctgtatattaggaataaaggaaaagttctaaactgcctctgcaatgacttgtagtcagtggaagagtatcactttcccctgatcatgaccactaaactgtaaattgatataaattagttttctctcgagttacacccaagtaatgaagacttaagagaaccttggttgaaataaatttccaatagtttggagactcataaataccatgcaggtgtaaccactgccaataggctgtttctatgcttatttcctattttgatttttactttgaagataggaatatctaaattatatctctagggagaaaatgttgtaaaaaattaaaagtacatccctgattgtaaaataaagttcaaaaaactgatttcagaaa

SEQ ID NO: 197797 - DNA, 657 bp, Homo sapiens
  Payload ID: 19005
  Gene Name: ubiquitin-like modifier activating enzyme 5
  ENST ID: ENST00000464068
  CDS Start-End: 326-657
aggtaacctgcgtcgccggtcggaggcaggcgcgggggacgaggtcaggctccgtgaggtcagaagtgaggcgcttcccacgtcccgctcatggggacgcccgccacccttttcttggtctgcgaatcctgttcccaaatgggcaaggccacatcttagtactgatcggaagatattctttctcttttttaaaaacctccagtgagtcagccatatggtgctgctcctgtgcctgctgaggacgtgtgtccagtttcctatcacccttgcctcttaattagtccgcctcgctgtgtataagactgatagtaagaactttcagaagatgagatcaaatattaaacctgctaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaac

SEQ ID NO: 197798 - DNA, 1513 bp, Homo sapiens
  Payload ID: 19005
  Gene Name: ubiquitin-like modifier activating enzyme 5
  ENST ID: ENST00000473651
  CDS Start-End: 179-1222
ggagtctcggagacgtgtctgtctgtgaggcgctgggtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagccgcttgatggcattgaaacgaatgggaattgtaagcgactatgagaaaatccgtacctttgccgtagcaatagtaggtgttggtggagtaggtagtgtgactgctgaaatgctgacaagatgtggcattggtaagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgttagtttttaccttggatacaatgcaatgcaggatttttttcctactatgtccatgaagccaaatcctcagtgtgatgacagaaattgcaggaagcagcaggaggaatataagaaaaaggtagcagcactgcctaaacaagaggttatacaagaagaggaagagataatccatgaagataatgaatgggcaagaagattctgtcactgagttaacagtggaagattctggtgaaagcttggaagacctcatggccaaaatgaagaatatgtagataatggactgggatatattgtatttctcatgttaaagcctcttcccttgaaattaaaaaaaaattttaactgataaaacttagggcaacattaattaatgtatattcttacctgaattgttatactttttgaaaatcctgtgacttgcctgtttctccccgctccaacgaaatcattaactctcctaaaatgtgtttcattctagtaagaaaacctcaaaggatat

SEQ ID NO: 197799 - DNA, 576 bp, Homo sapiens
  Payload ID: 19005
  Gene Name: ubiquitin-like modifier activating enzyme 5
  ENST ID: ENST00000505777
  CDS Start-End: 143-337
gtgcacgtccccagggctctgggctaggaaggcagcggcgaggtgcctccccacgtacccctcgcgggcccagccgagcaacgtggggcgaaggcggcggcgaaggcccgggctgggagcgttggcggccggagtcccagccatggcggagtctgtggagcgcctgcagcagcgggtccaggagctggagcgggaacttgcccaggagaggagtctgcaggtcccgaggagcggcgacggagggggcggccgggtccgcatcgagaagatgagctcagaggtggtggattcgaatccctacagttgctactctttgattatgacaaggtggaactagccaatatgaatagacttttcttccaacctcatcaagcaggattaagtaaagttcaagcagcagaacatactctgaggaacattaatcctgatgttctttttgaagtacacaactataatataaccacagtggaaaactttcaacatttcatggatagaataagtaatggtgggttagaagaaggaaaacctgttgatctagttcttagctgtgtggacaattttgaagctcgaatgaca

SEQ ID NO: 197800 - DNA, 9564 bp, Homo sapiens
  Payload ID: 19006
  Gene Name: ubiquitin-like modifier activating enzyme 6
  Uniprot ID: A0AVT1
  ENST ID: ENST00000322244
  CDS Start-End: 61-3219
ccccccacggtcccgccccttcctaccttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaagcctgatgtaaatgctgacattgtgcattggctctcttggactgcccaaggctttttatctccacttgctgcagcagtaggaggtgttgccagccaagaagtattgaaagctgtaacaggaaaattttctcctttgtgccagtggttatatcttgaagcagcagatattgttgaatcactaggcaaacctgaatgtgaagaatttctcccacgaggagatagatatgatgccttaagagcttgcattggagacactttgtgtcagaaactgcaaaatttaaacatcttcttagtagggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacataccatacagtgggcaagagataagtttgaaagttccttttcccacaaaccttcattgtttaacaaattttggcaaacctattcatctgcagaagaagtcttacagaagatacagagtggacacagtttagaaggctgttttcaagttataaagttacttagcagaagacctagaaattggtcccagtgtgtagaattagcaagattaaagtttgaaaaatattttaaccataaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggacttatcagcagatgccctcttgaatattctttcagaagtaaagattcaggaattcaagccttccaataaggttgttcaaacagatgaaactgcaaggaaaccagaccatgttcctattagcagtgaagatgagaggaatgcaattttccaactagaaaaggctattttatctaatgaagccaccaaaagtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggttgccttggagatgatcaaagtaactggtggctatccatttgaagcttacaaaaattgttttcttaacttagccattccaattgtagtatttacagagacaactgaagtaaggaaaactaaaatcagaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtaatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataattgtctctttgtttttatagtgttaccacctatgtgtgtaaacttaaacaatacagtttgcttgtttttgagttttatttaaaatcatacattcttttgtagctgcatttgttcaagatgggattgattcatgttggttgtagctgtactttattcttcattatgtctgtgtaatttacttttctgttaatatgccacaatttatttactgtagacaattgggatgtttttagtttcaggcaattacagtttcacaatgaacatcattttatgtaactcctagtacaaagagtatatatttaggagtagaattttttggtcatagggtattcatatcttaaattttattagatgattacaaatttttttctaagcattagtatgttggttggttttgtgttgctataaaggaatatccaagactcggtaattcataaagaaaaaaggtttatttggctcatggttcagcaggttgtacaaacattgcaccagcatccctgcaatcatggcagaaggcaaaggaggaactggcgtatcacatggctagaggagcaagagagaaatagaggaagtcccagatcatttttaagaatcagatctcacattaactcatggagcaagaactcgtcatctcaacgagggcaccaagccatttatgagggatccagatatccatccccataacccgaacacctcccaccagccctcacctccaacactggggatcacatttcaacatgatatttgcaggggacaaatatccaaaccatatttctccatatcttggtcagtgctggtgttaacagtttttgtttttaattttgccaatctggtggatgtgcaattgtatctcattgaagtgtcactctgcatttctctattacctgtgaagttgagtattttttcataagtttattggccaatttgactttctgtttttgtaaagtatcttgtcaggactgccacacgtttttgttgtgttgctaatctttttcctcattgattcataaaggatctttataaatcttattctttgttggctgtatagttgccaatatcttctcccaatttgtggcttgcctttccctcccttatgatgttctttgataaaaacaatttattaatggttaagtactaggaagtatgagtgttttaaaattagagcgtgagttgttttaaaaaaccattccctaccctggagtcatgaagatagtcttatatatcgtcttcttaaagctttagttttgcctttcatatttaaatttttttcatgaggaattaatttggtgtatgctaggagatgcctcactaccgtttattgaaaaatctgggttttattcctcctttctatagtgccaccaaagtcatgtattatacccgtatgtgaatacagatttcatcaacatctgttgatgaaaagagtcaaactctgtaaatattttcagagattattctgagccaaatatgagtgaccatggcctgtgacccagccctcaggaggtccagagaacatgtgccccaggtggtcagagtacatcttggttttatatagaaggcatgagacatcaaatacgtttaagaaatgcattggtttggttcagaaaggcaggacaactcaaagcgggggcttccagggtataggttaatttaaaacattttctggttgacaattggtcgagtttatctgaagacctgggatcaataggaaggaaatattcaggttaaataagagattgtggagaacaagttttattgtgcagaggaaactctcagcagacttcaaagagagcaggttgtaaagtgtttcttattggacctaaaaggatgcctgggtcttagttgattatctcctggatttggaaaggaaggaaggacaaaaaaaaaatgggtaaaggggaaaggggattctttatagaatgtagatttttcccacaagggatggctttgcagggccatttcaagatatggcagagaaacatatttcggggtaaaatattttgattttctttcttgttatgccagagtcagattggaaagttaagtcacaatatacagggttaaataaaacccatctgatgagaatttatggtttgtagagcatgactccccagactccttagacaggaatttgggcaagataacaaaatatcagagcttagtccttacatctctttctaaacattttttcccttttttctatccctgtgctagtataccatcatcatcatcattgtagctgatatattcttgatatctggccaaacaaatcctcccaacttattgttcttttagagtatcttggttattctcagccccttgtattttcagttctcatatttctaattgaaagcatgtaaatttgtcactcctgcagtttctaattgtcttgctgaaattttcaatttcttatctgcttcaaaatgaaaagcataattattttctagtctgtctaataattccagaatcaaaacccgcctgtgggtctgtttttattttgtttgttctagtcttcattcttactgtcttgtctccttgtgtgcctggttacctttaattatttaccaatattgtttgaaaaaactagaaataacttgatgctcagaatgatatttttatcctccacagagttttttgcttctggcaggtacctgcattagtaatttaggattattttgatccagtttcagatactgaaattttccaggtcacctaggtgactgaaagctgagccacagactgtggtaatgctcttctgttcatccttatttctagggttcaaccattcagggtttcaaagcatggtttggagttaccaggcccttacctcttcactgaccctggactctttttgaatctttagccccttagctctatctactcaacttcccagtggccttttgcaatctataaatactcctaacacagtggtcccaaatgaatggttcatttttctgaatttctatcttttctcagatattattggcatggtaattattcaccaacttatcagctccctgctgccttcctacatctttgaaaagtatattttatccagcttttctaaatgttttcaagtgagaatgttaatccaaattacttagcccacattatttcctgttgattatgtgtaaaatacagttggtttatttgtattgtttttgtacctggaaacaataaactctgtagtgattctctaaa

SEQ ID NO: 197801 - DNA, 1664 bp, Homo sapiens
  Payload ID: 19006
  Gene Name: ubiquitin-like modifier activating enzyme 6
  Uniprot ID: A0AVT1
  ENST ID: ENST00000420827
  CDS Start-End: 35-1204
cttccagtagccggcggcggtgtctcaggcggcaatggaaggatccgagcctgtggccgcccatcagggggaagaggcgtcctgttcttcctgggggactggcagcacaaataaaaatttgcccattatgtcaacagcatctgtggaaatcgatgatgcattgtatagtcgacagaggtacgttcttggagacacagcaatgcagaagatggccaagtcccatgttttcttaagtgggatgggtggtcttggtttggaaattgcaaagaatcttgttcttgcagggattaaggcagttacaattcatgatacagaaaaatgccaagcatgggatctaggaaccaacttctttctcagtgaagatgatgttgttaataagagaaacagggctgaagctgtacttaaacatattgcagaactaaatccatacgttcatgtcacatcatcttctgttcctttcaatgagaccacagatctctcctttttagataaataccagtgtgtagtattgactgagatgaaacttccattgcagaagaagatcaatgacttttgccgttctcagtgccctccaattaagtttatcagtgcagatgtacatggaatttggtcaaggttattttgtgatttcggtgatgaatttgaagttttagatacaacaggagaagaaccaaaagaaattttcatttcaaacataacgcaagcaaatcctggcattgttacttgccttgaaaatcatcctcacaaactggagacaggacaattcctaacatttcgagaaattaatggaatgacaggtttaaatggatctatacaacaaataacggtgatatcgccattttcttttagtattggtgacaccacagaactggaaccatatttacatggaggcatagctgtccaagttaagactcctaaaacagttttttttgaatcactggagaggcagttaaaacatccaaagtgccttattgtggattttagcaaccctgaggcacctttagagattcacacagctatgcttgccttggaccagtttcaggagaaatacagtcgcaagccaaatgttggatgccaacaagattcagaagaactgttgaaactagcaacatctataagtgaaaccttggaagagaaggtgactattgaaatttatggctgtccgaatatttgtttgttaatacataagtgttctgtatattagtattctcttatccttcacatccagctttgctactctgtggcattagacaacttttttcagtttgttctgttttaatttataaatctataaaatagagttaacctaccttcatagggttattgtgaacattaaataatttaattttgtaaagtacttagaaatgccatgtgacatatagtaattaatatttgctgctatttttttaactgttactattattctttattattctgttatgatttacttgatttgttaacttaaacttatatatgttagctttcttatataagtcacctgttttatatattatacattcatatctctttatcacatttcgtacatcagatttagatttaaacatttcacctagaaaatggtttttttgtgtgtgttatgatgccagtgcctgcttgtcaacagttttatttgagcagctataaacatggtgatgtttgtgcaa

SEQ ID NO: 197802 - DNA, 812 bp, Homo sapiens
  Payload ID: 19006
  Gene Name: ubiquitin-like modifier activating enzyme 6
  ENST ID: ENST00000505673
  CDS Start-End: 1-812
ggtgtggagccataggctgtgaaatgttgaaaaattttgctttacttggtgttggcacaagcaaagagaaaggaatgattacagttacagatcctgacttgatagagaaatccaacttaaatagacagttcctatttcgtcctcatcacatacagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacagtcgttgcttagcaaatctaaggcctcttttagattctggaacaatgggcactaagggacacactgaagttattgtaccgcatttgactgagtcttacaatagtcatcgggatcccccagaagaggaaataccattttgtactctaaaatcctttccagctgctattgaacataccatacagtgggcaagagataagtttgaaagttccttttcccacaaaccttcattgtttaacaaattttggcaaacctattcatctgcagaagaagtcttacaggctcttcagcttcttcactgtttccctctggacatacgattaaaagatggcagtttattttggcagtcaccaaagaggccaccctctccaataaaatttgatttaaatgagcctttgcacctcagtttccttcagaatgctgcaaaactatatgctacagtatattgtattccatttgcagaagaggtaagatattct

SEQ ID NO: 197803 - DNA, 623 bp, Homo sapiens
  Payload ID: 19006
  Gene Name: ubiquitin-like modifier activating enzyme 6
  ENST ID: ENST00000514261
  CDS Start-End: 1-267
aaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttgaaatggaatatcatttacaatttgggatcgatggaccgtacatggaaaagaagatttcaccctcttggatttcataaatgcagtcaaagagaagtatggaattgagccaacaatggtggtacagggagtcaaaatgctttatgttcctgtaatgcctggtcatgcaaaaagattgaagttaacaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaa

SEQ ID NO: 197804 - DNA, 3299 bp, Homo sapiens
  Payload ID: 19007
  Gene Name: ubiquitin-like modifier activating enzyme 7
  Uniprot ID: P41226
  ENST ID: ENST00000333486
  CDS Start-End: 160-3198
ccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaagg

SEQ ID NO: 197805 - DNA, 3965 bp, Homo sapiens
  Payload ID: 19008
  Gene Name: ubiquitin-like with PHD and ring finger domains 1
  ENST ID: ENST00000620565
  CDS Start-End: 45-2618
gcgcccgcccccggcacggcctcctgcggccccgcaactcccaaatgccgagttttcgcgggaaaaaaatcagagcagctggcagcgcggcgggcagcgtttgccgagcgggcgctccgggtcgcacgcaagtccgcgcggggtccgggccacgcacgcggtttcatcgccatccccagccgggccacgcgcgcaggcagacaagctgttcgcggcgaccggagagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacaga

SEQ ID NO: 197806 - DNA, 2661 bp, Homo sapiens
  Payload ID: 19008
  Gene Name: ubiquitin-like with PHD and ring finger domains 1
  Uniprot ID: Q96T88
  ENST ID: ENST00000616255
  CDS Start-End: 131-2512
gaggggtcccggggtccgcggatctcgggtggggtttttccctctcagtggcacttggttgagttcccccgggacttctgaagttccggcccgcgctggacttctgggattccctcttcccgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttattt

SEQ ID NO: 197807 - DNA, 2651 bp, Homo sapiens
  Payload ID: 19008
  Gene Name: ubiquitin-like with PHD and ring finger domains 1
  Uniprot ID: Q96T88
  ENST ID: ENST00000615884
  CDS Start-End: 112-2493
gggctcgctggcgcgacccgcgcgggccagtgggagtgcgggagggacgccgagggtccagggtttggaggggcgcgagctgccgggggttggaggtcgagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttc

SEQ ID NO: 197808 - DNA, 3230 bp, Homo sapiens
  Payload ID: 19008
  Gene Name: ubiquitin-like with PHD and ring finger domains 1
  ENST ID: ENST00000622802
  CDS Start-End: 481-2901
tgggcaccgaggggtcccggggtccgcggatctcgggtggggtttttccctctcagtggcacttggttgagttcccccgggacttctgaagttccggcccgcgctggacttctgggattccctcttccgtaaataggaatccgaggaatgaatgaatcaatgaatgaatgaataaacgaaccaactcggccacttggcccgggcctcctttctcctctggtcgtggggaaggagggatgggttggaccttctgcttttctttcaattccctcttttcattctccttcctcctcaatcttcaacacttggctagtcgttaatgccttaagtgcttaatttgttgtgtctggtcctggccagggtctggctgtacaggaggactggaagggcatcctgggagtttcctggtgtccacaggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctgg

SEQ ID NO: 197809 - DNA, 1859 bp, Homo sapiens
  Payload ID: 19008
  Gene Name: ubiquitin-like with PHD and ring finger domains 1
  ENST ID: ENST00000613817
  CDS Start-End: 1-1491
atcagagcagctggcagcgcggcgggcagcgtttgccgagcgggcgctccgggtcgcacgcaagtccgcgcggggtccgggccacgcacgcggtttcatcgccatccccagccgggccacgcgcgcaggcagacaagctgttcgcggcgaccggagagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaag

SEQ ID NO: 197810 - DNA, 4309 bp, Homo sapiens
  Payload ID: 19008
  Gene Name: ubiquitin-like with PHD and ring finger domains 1
  Uniprot ID: Q96T88
  ENST ID: ENST00000612630
  CDS Start-End: 577-2958
gcaggggtgccatcttggctcactgcaacctccgcctcatgggttcaagcaattctcctgcctcagcctcctgagtagctgggaccacgggtgcatgccagcatgcccagctaattttttggtagagacagagtttcactgtgttggccaggatggtctcgatctcctgacctcgtgatccacccacctcagcctcccaaagtgctgggattgcaggcgtgagccactgcacctgggctttttctttttttgagacaaagtctcattctgtcacccaggctggagtgtagtggcgcgatctcggctcactgccacatctgcctcccgggttcaagcaattctcctgcttcagcctcctgagtagctggaattacaggcatgcaccatcaccatgctttgctaatttttttttggtatttttatttattttatttttattttttgtgatggtctcactctgtcagccagactggagtgcaatggtgtgatctcggctcactgcaacctctgcctcctgggttccagcgattctcccacctcagccccccaagtacctgagattacagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagataga

SEQ ID NO: 197811 - DNA, 3898 bp, Homo sapiens
  Payload ID: 19008
  Gene Name: ubiquitin-like with PHD and ring finger domains 1
  Uniprot ID: Q96T88
  ENST ID: ENST00000624301
  CDS Start-End: 169-2550
atcagagcagctggcagcgcggcgggcagcgtttgccgagcgggcgctccgggtcgcacgcaagtccgcgcggggtccgggccacgcacgcggtttcatcgccatccccagccgggccacgcgcgcaggcagacaagctgttcgcggcgaccggagagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagat

SEQ ID NO: 197812 - DNA, 3452 bp, Homo sapiens
  Payload ID: 19009
  Gene Name: ubiquitin-like with PHD and ring finger domains 2, E3 ubiquitin protein ligase
  Uniprot ID: Q96PU4
  ENST ID: ENST00000276893
  CDS Start-End: 169-2577
agagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaa

SEQ ID NO: 197813 - DNA, 802 bp, Homo sapiens
  Payload ID: 19009
  Gene Name: ubiquitin-like with PHD and ring finger domains 2, E3 ubiquitin protein ligase
  ENST ID: ENST00000381373
  CDS Start-End: 74-484
gcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataagggtctggctctgtcacccaggctgtagtgcagtgacgtgaacacggctcgctgtagccttgacctgctggggtcaagtgatcttcctgctcggcctcccaaagtgctgggatacaggcgtgagccaccatgcccggctaacttagatctttgatatcttgattagttctttctttacatatttaatattttgctttatttctggtagctttgtttttgatgcaattattatatatggttatcttctaaaatagtaatctgtttgctgatatagagaaatgaaattgatttatttggcttttgtaaccagcaaccttttcaaatctaataaattgtgtagaaataa

SEQ ID NO: 197814 - DNA, 474 bp, Homo sapiens
  Payload ID: 19009
  Gene Name: ubiquitin-like with PHD and ring finger domains 2, E3 ubiquitin protein ligase
  ENST ID: ENST00000450508
  CDS Start-End: 138-474
ctgttctaatagtccacctaaagtaaagaaagctccgagggtaggaccttccaatcagccatctacatcagctcgtgcccgtcttattgatcctggctttggaatatataagatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtg

SEQ ID NO: 197815 - DNA, 3723 bp, Homo sapiens
  Payload ID: 19009
  Gene Name: ubiquitin-like with PHD and ring finger domains 2, E3 ubiquitin protein ligase
  Uniprot ID: Q96PU4
  ENST ID: ENST00000468435
  CDS Start-End: 341-1852
gcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcttgacagagttatgaatatgaatattgtggagtctgtccagataccgggtggaagactggttttgatcagtttaagaagtattctaaactgttctagatgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaaaaa

SEQ ID NO: 197816 - DNA, 6529 bp, Homo sapiens
  Payload ID: 19010
  Gene Name: ubiquitously transcribed tetratricopeptide repeat containing, Y-linked
  Uniprot ID: O14607
  ENST ID: ENST00000331397
  CDS Start-End: 1009-5052
tttgctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197817 - DNA, 4325 bp, Homo sapiens
  Payload ID: 19010
  Gene Name: ubiquitously transcribed tetratricopeptide repeat containing, Y-linked
  Uniprot ID: O14607
  ENST ID: ENST00000329134
  CDS Start-End: 1006-4245
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagctggaatgcaatggtgtgatctcagctcactgcagcctccgcctcctgggttcaagcgattctcccacctcagcctcccgaatagctggaattacaggcacctgccatcatgcccaactaatttttgtatttttgtagagacagggtttcaccatgttggccaggcttgtcttgaactcctgacctcaggtggtctgcttgcctcagcatcccaaagtgctgggattacaggtgtgagccaccatgcccggtaaacttttaaaaatgtaagcaaaattacagtatgtaaaacacacattgctaatggagaaataaagttcctactttacatcta

SEQ ID NO: 197818 - DNA, 4990 bp, Homo sapiens
  Payload ID: 19010
  Gene Name: ubiquitously transcribed tetratricopeptide repeat containing, Y-linked
  Uniprot ID: O14607
  ENST ID: ENST00000362096
  CDS Start-End: 1006-4728
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtaagtgccttctgaaactgctgcagtttctctttgggggtattggtagccattcagtatttttttcaaaagaattctgttgacattaaatgatatcagcagtccagaagtcttggcaaaatgtaataagatgtaaataatcttatatattcataagtgttataaaatctcataagattaaaatattgccttcccttacagatagtcacttgtgtttattacaatttagagaggaataaagatgtacatgaatatacactggtaaa

SEQ ID NO: 197819 - DNA, 1539 bp, Homo sapiens
  Payload ID: 19010
  Gene Name: ubiquitously transcribed tetratricopeptide repeat containing, Y-linked
  ENST ID: ENST00000382893
  CDS Start-End: 314-937
gcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaagtaagtatttttaaatgaaatacttttgagtaaagaatattaatgatacctttttttctactgatacctttgtttctgttcattcttgagaagagaagtgagaaggcatgtgcctgattcagagagtttaaatcactggagttgagttgatttgggtactatttttcttgctcaaagacagtcagtattattatttgataactgtagaaatgattggtatgtcacagagcactaacaaatagtgattacctactttagtagtttttctccctttatggtgtctatgttttcatattaatgaattacttcaccttttaatattttaggatttgcacataccgtaagcttgactattttttgaaacttttttgtgtacttggtgatgttgcaaaaatcaaaagttttcaaagccaattttaaacaaaacctgaataagttaaaaatgtgtagtttaaaaaataaatactgttttttgaactctttcagatgaatgactacagttaatattttgggaaaaaaacatgtttaaaaagaatatgaaactttaaattatgtgattttcctttgtgataaaaatgttagaatattaaagaccttttatgtcaattttttacct

SEQ ID NO: 197820 - DNA, 6661 bp, Homo sapiens
  Payload ID: 19010
  Gene Name: ubiquitously transcribed tetratricopeptide repeat containing, Y-linked
  Uniprot ID: O14607
  ENST ID: ENST00000382896
  CDS Start-End: 1006-5184
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197821 - DNA, 6490 bp, Homo sapiens
  Payload ID: 19010
  Gene Name: ubiquitously transcribed tetratricopeptide repeat containing, Y-linked
  ENST ID: ENST00000537580
  CDS Start-End: 1006-5013
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197822 - DNA, 6652 bp, Homo sapiens
  Payload ID: 19010
  Gene Name: ubiquitously transcribed tetratricopeptide repeat containing, Y-linked
  ENST ID: ENST00000540140
  CDS Start-End: 1006-5175
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaagtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197823 - DNA, 6817 bp, Homo sapiens
  Payload ID: 19010
  Gene Name: ubiquitously transcribed tetratricopeptide repeat containing, Y-linked
  ENST ID: ENST00000545955
  CDS Start-End: 1006-5340
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcaggcttatagagctcatgatccaaatactgaacatgtattaaaccacagtcaaacaccaattttacagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197824 - DNA, 6574 bp, Homo sapiens
  Payload ID: 19010
  Gene Name: ubiquitously transcribed tetratricopeptide repeat containing, Y-linked
  ENST ID: ENST00000538878
  CDS Start-End: 1006-5097
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggcctaccttggacatcttacaggtttcatacaagacaactgcaataaagggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197825 - DNA, 6682 bp, Homo sapiens
  Payload ID: 19010
  Gene Name: ubiquitously transcribed tetratricopeptide repeat containing, Y-linked
  ENST ID: ENST00000617789
  CDS Start-End: 1006-5205
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggcttatagagctcatgatccaaatactgaacatgtattaaaccacagtcaaacaccaattttacagcaatccttgtcactacacatgattacttctagccaagtagaaggcctgtccagtcctgccaagaagaaaagaacatctagtccaacaaagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197826 - DNA, 6277 bp, Homo sapiens
  Payload ID: 19010
  Gene Name: ubiquitously transcribed tetratricopeptide repeat containing, Y-linked
  ENST ID: ENST00000618474
  CDS Start-End: 1006-4800
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197827 - DNA, 6586 bp, Homo sapiens
  Payload ID: 19010
  Gene Name: ubiquitously transcribed tetratricopeptide repeat containing, Y-linked
  ENST ID: ENST00000612274
  CDS Start-End: 1006-5109
gctcatcgtttgttgtttagataatatcatgaactgataaatgcagttgccacgttgattccctagggcctggcttaccgactgaggtcataagatattatgccttctctttagacttggtcagtggagaggaaatgggcaaagaaccagcctatggaggtgacaaggccttagggccaaaagtcttgagggtgaaggtttagggcctgcgcagcttccctgccatgccccgcaaggtctcgcattcgcaaggcttgtgacagtgggagcctcattacggactctcctaaagtccatggtgtcctcttttcgcatttgcgccccgtgggtgatgcccgatgccgcccttcccatcgctctcttccccttcaagcgtatcgcaactgcaaaaacacccagcacagacactccattttctatcttaatgcatttaactagcacaacctacaggttgttccatcccagagactacccttttctccatagacgtgaccatcaaccaaccagcggtcagaatcagtcagcctctgtcatgttcctaggtccttggcgaactggctgggcggggtcccagcagcctaggagtacagtggagcaatgcctgacgtaagtcaacaaagatcacgtgagacgaatcagtcgcctagattggctacaactaagtggttgggagcggggaggtcgcggcggctgcgtggggttcgcccgtgacacaattacaactttgtgctggtgctggcaaagtttgtgattttaagaaattctgctgtgctctccagcactgcgagcttctgccttccctgtagtttcccagatgtgatccaggtagccgagttccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggtacgaactactggaattcataacggggccataactgattcatcactgcctacaaactctgtctctaatcgacaaccacatggtgctctgaccagagtatctagcgtctctcagcctggagttcgccctgcttgtgttgaaaaacttttgtccagtggagctttttctgcaggctgtattccttgtggcacatcaaaaattctaggaagtacagacactatcttgctaggcagtaattgtatagcaggaagtgaaagtaatggaaatgtgccttacctgcagcaaaatacacacactctacctcataatcatacagacctgaacagcagcacagaagagccatggagaaaacagctatctaactccgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggtggaggtttttaatctgctttttgtcactaatgaaagcaatactcaaaaaacctacatagtacattgccatgattgtgcacgaaaaacaagcaaaagtttggaaaattttgtggtgctcgaacagtacaaaatggaggacctaatccaagtttatgatcaatttacactagctctttcattatcatcctcatcttgatatagttccatgaatattaaatgagattatttctgctcttcaggaaatttctgcaccactggttttgtagctgtttcataaaactgttgactaaaagctatgtctatgcaaccttccaagaatagtatgtcaagcaactggacacagtgctgcctctgcttcaggacttaacatgctgatccagctgtacttcagaaaaataatattaatcatatgttttgtgtacgtatgacaaactgtcaaagtgacacagaatactgatttgaagatagccttttttatgtttctctatttctgggctgatgaattaatattcatttgtattttaaccctgcagaattttccttagttaaaaacactttcctagctggtcatttcttcataagatagcaaatttaaatctctcctcgatcagcttttaaaaaatgtgtactattatctgaggaagttttttactgctttatgtttttgtgtgttttgaggccatgatgattacatttgtggttccaaaataatttttttaaatattaatagcccatatacaaagataatggattgcacatagacaaagaaataaacttcagatttgtgatttttgtttctaaacttgatacagatttacactatttataaatacgtatttattgcctgaaaatatttgtgaatggaatgttgtttttttccagacgtaactgccattaaatactaaggagttctgtagttttaaacactactcctattacattttatatgtgtagataaaactgcttagtattatacagaaatttttattaaaattgttaaatgtttaaagggtttcccaatgtttgagtttaaaaaagactttctgaaaaaatccactttttgttcattttcaaacctaatgattatatgtattttatatgtgtgtgtatgtgtacacacatgtataatatatacagaaacctcgatatataattgtatagattttaaaagttttattttttacatctatggtagtttttgaggtgcctattataaagtattacggaagtttgctgtttttaaagtaaatgtcttttagtgtgatttattaagttgtagtcaccatagtgatagcccataaataattgctggaaaattgtattttataacagtagaaaacatatagtcagtgaagtaaatattttaaaggaaacattatatagatttgataaatgttgtttataattaagagtttcttatggaaaagagattcagaatgataacctcttttagagaacaaataagtgacttatttttttaaagctagatgactttgaaatgctatactgtcctgcttgtacaacatggtttggggtgaaggggaggaaagtattaaaaaatctatatcgctagtaaattgtaataagttctattaaaacttgtatttcatatgaaaaatttgctaatttaatattaactcatttgataataatacttgtcttttctacctctc

SEQ ID NO: 197828 - DNA, 3636 bp, Homo sapiens
  Payload ID: 19010
  Gene Name: ubiquitously transcribed tetratricopeptide repeat containing, Y-linked
  Uniprot ID: O14607
  ENST ID: ENST00000624098
  CDS Start-End: 1-3636
atgaaatcctgcgcagtgtcgctcactaccgccgctgttgccttcggtgatgaggcaaagaaaatggcggaaggaaaagcgagccgcgagagtgaagaggagtctgttagcctgacagtcgaggaaagggaggcgcttggtggcatggacagccgtctcttcgggttcgtgaggcttcatgaagatggcgccagaacgaagaccctactaggcaaggctgttcgctgctacgaatctttaatcttaaaagctgaaggaaaagtggagtctgacttcttttgccaattaggtcacttcaacctcttgttggaagattattcaaaagcattatctgcatatcagagatattacagtttacaggctgactactggaagaatgctgcgtttttatatggccttggtttggtctacttctactacaatgcatttcattgggcaattaaagcatttcaagatgtcctttatgttgaccccagcttttgtcgagccaaggaaattcatttacgacttgggctcatgttcaaagtgaacacagactacaagtctagtttaaagcattttcagttagccttgattgactgtaatccatgtactttgtccaatgctgaaattcaatttcatattgcccatttgtatgaaacccagaggaagtatcattctgcaaaggaggcatatgaacaacttttgcagacagaaaaccttcctgcacaagtaaaagcaactgtattgcaacagttaggttggatgcatcataatatggatctagtaggagacaaagccacaaaggaaagctatgctattcagtatctccaaaagtctttggaggcagatcctaattctggccaatcgtggtattttcttggaaggtgttattcaagtattgggaaagttcaggatgcctttatatcttacaggcaatctattgataaatcagaagcaagtgcagatacatggtgttcaataggtgtgttgtatcagcagcaaaatcagcctatggatgctttacaggcatatatttgtgctgtacaattggaccatgggcatgccgcagcctggatggacctaggtactctctatgaatcctgcaatcaacctcaagatgccattaaatgctacctaaatgcagctagaagcaaacgttgtagtaatacctctacgcttgctgcaagaattaaatttctacaggctcagttgtgtaaccttccacaaagtagtctacagaataaaactaaattacttcctagtattgaggaggcatggagcctaccaatccccgcagagcttacctccaggcagggtgccatgaacacagcacagcagaatggttctgataactggaatggtggccagagtctttcacatcatccagtacagcaagtttattcgttgtgtttgacaccacagaaattacagcacttggaacaactgcgagcaaatagagataatttaaatccagcacagaagcatcagctggaacagttagaaagtcagtttgtcttaatgcagcaaatgagacacaaagaagttgctcaggggcttcataaaagtcagagttcatgtttgtcaggacctaatgaagaacaacctctgttttccactgggtcagcccagtatcaccaggcaactagcactggtattaagaaggcgaatgaacatctcactctgcctagtaattcagtaccacagggggatgctgacagtcacctctcctgtcatactgctacctcaggtggacaacaaggcattatgtttaccaaagagagcaagccttcaaaaaatagatccttggtgcctgaaacaagcaggcatactggagacacatctaatggctgtgctgatgtcaagggactttctaatcatgttcatcagttgatagcagatgctgtttccagtcctaaccatggagattcaccaaatttattaattgcagacaatcctcagctctctgctttgttgattggaaaagccaatggcaatgtgggtactggaacctgtgacaaagtgaataatattcacccagctgttcatacaaagactgatcattctgttgcctcttcaccctcttcagccatttccacagcaacaccttctcctaaatccactgagcagagaagcataaacagtgttaccagccttaacagtcctcacagtggattacacacagtcaatggagaggggctggggaagtcacagagctctacaaaagtagacctgcctttagctagccacagatctacttctcagatcttaccatcaatgtcagtgtctatatgccccagttcaacagaagttctgaaagcatgcaggaatccaggtaaaaatggcttgtctaatagctgcattttgttagataaatgtccacctccaagaccaccaacttcaccatacccacccttgccaaaggacaagttgaatccacccacacctagtatttacttggaaaataaacgtgatgctttctttcctccattacatcaattttgtacaaatccaaaaaaccctgttacagtaatacgtggccttgctggagctcttaaattagatcttggacttttctctaccaaaactttggtagaagctaacaatgaacatatggtagaagtgaggacacagttgctgcaaccagcagatgaaaactgggatcccactggaacaaagaaaatctggcgttgtgaaagcaatagatctcatactacaattgccaaatacgcacaataccaggcttcctccttccaggaatcattgagagaagaaaatgagaaaagaacacaacacaaagatcattcagataacgaatccacatcttcagagaattctggaaggagaaggaaaggaccttttaaaaccataaaatttgggaccaacattgacctctctgataacaaaaagtggaagttgcagttacatgaactgactaaacttcctgcttttgcgcgtgtggtgtcagcaggaaatcttctaacccatgttgggcataccattctgggcatgaatacagtacaactgtatatgaaagttccagggagtcggacaccaggtcaccaagaaaataacaacttctgctctgttaacataaatattggtccaggagattgtgaatggtttgttgtacctgaagattattggggtgttctgaatgacttctgtgaaaaaaataatttgaattttttaatgagttcttggtggcccaaccttgaagatctttatgaagcaaatgtccctgtgtatagatttattcagcgacctggagatttggtctggataaatgcaggcactgtgcattgggttcaagctgttggctggtgcaataacattgcctggaatgttggtccacttacagcctgccagtataaattggcagtggaacggtatgaatggaacaaattgaaaagtgtgaagtcaccagtacccatggtgcatctttcctggaatatggcacgaaatatcaaagtctcagatccaaagctttttgaaatgattaagtattgtcttttgaaaattctgaagcaatatcagacattgagagaagctcttgttgcagcaggaaaagaggttatatggcatgggcggacaaatgatgaaccagctcattactgtagcatttgtgaggctctttcattatcatcctcatcttga

SEQ ID NO: 197829 - DNA, 574 bp, Homo sapiens
  Payload ID: 19011
  Gene Name: ubiquitously-expressed, prefoldin-like chaperone
  Uniprot ID: Q9UBK9
  ENST ID: ENST00000333119
  CDS Start-End: 57-530
cggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgccttt

SEQ ID NO: 197830 - DNA, 701 bp, Homo sapiens
  Payload ID: 19011
  Gene Name: ubiquitously-expressed, prefoldin-like chaperone
  ENST ID: ENST00000335890
  CDS Start-End: 155-664
gaggtaaaggccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaa

SEQ ID NO: 197831 - DNA, 627 bp, Homo sapiens
  Payload ID: 19011
  Gene Name: ubiquitously-expressed, prefoldin-like chaperone
  ENST ID: ENST00000485641
  CDS Start-End: 145-444
ccgcgcttgggtgtccctgggtggtcgggtccccgagttgggaggggcggaaggctgaacctccagcttgagccggacaagccgattcccagcgttgagagggtagagatgaactgtgtgtgaggccaaactggatcggtcaacatggtcttccccctccccactccccaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccagcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcc

SEQ ID NO: 197832 - DNA, 4631 bp, Homo sapiens
  Payload ID: 19012
  Gene Name: U-box domain containing 5
  Uniprot ID: O94941
  ENST ID: ENST00000217173
  CDS Start-End: 473-2098
ttttgtatttttagtagagacgggggtttcaccacgttagccaggctggtctcgaactcctgaactcaggtgatccgcccgccttggcctcccaaagtactgggattacaggcgtgagccaccgcgccgggactaagctgcttaatgacttccagagcgatccatccaggaaggtgttttccctctgcaggtcctagactccccctgcctcctcaacaacgtcctccagtggaaaatgtccttgggaaacgctgacagagtcttttgagcctcggccgcatccgtcactcgcgcagcaggcggaagtagcgggcagttggccggaagtggggctgtgaggctcggagtcgccggaggagccagtatctgtgtcgccgccgcccgcggcgtccccggtttggtgttgcggcgcccaccttcgggaggatcaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgccctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgtttgggaaggaacagcctaaagatgctttgtaaagctgtattttacccttgagcttagccgcgggtccctgtgaaccggcacattcctttcctttaggccgtccagagctctagtccacacccaatactttagagatctgggtttggggttagttgcttttttttttttttttttaattgagacagggttggtctctgttgcccaagcttgagggcagtggtgcaatcataactcattgcagcctcgaactcctgggcttaagggatccttctacctcagcctcccaggtagcaggaactataggcatgtgccaccatgcccagctaatttttttattttttgtagagacaaggtcttgctatgttgtccagactggtctcaaactcctgggctcaagcgatcctcccaaagtgcttggattgcaggcatgagccacttcgcctagccaagcctgcatttttttgagttcctacatcatttgtccacaaagatggcttcagagaggtggtcacatgctttgctctgcttcctcttggcactgaccttgatgcagccttcacatgagatttgagggtccgcatggatggcctgtgccgccctcgctggcgaggctcctgtgtgcccctggctttctgggtctgtgcctctccagaatcttgtcttaccctccggtgtgcttgtgttcttagaaaagccccagcatggccgggcatggtggctcatgcctattatcccagcactttgggaggccaaggtgggtggatcacttgaggtcaagagttcgagaccagcctggccaacatggcaaaaccccatctctactaaaaatacaaaaattagctgggcatggtggtgtgtgcctgtaatgccagctactcaggaggctgaggcatgagaatcgcttgaaccggggaggcagaggttgcagtgagccgagatctcaccactgtactccagcctgggcgacggagtgagactccctctcaaaaaaagaaaaaagccccagcatgtagcaaaagcatttcttggtgagtgtgggggctggtgattcccaccttcaccctgtcatggtctcagggaacagcctgcttcccaccagcagcttgacacccacagtgtgctctggctgctgggagcccatctctcggagaaaccctgtccacccaaccccgagagccctagcgtgcagtcagcgtcagcacggcgctcccagatgagggccggactgcctccccttaagcagctgtgttggaggtactgcccagaccgctgcaggtccctggggatctgcatttctaacaggctcctgcccccaagactgctctggtggaaaatccagcctgggagcccctggagtggcaggccctgtcctgggtacaggtggagccacccccaggagttgcgtgtgtttttcttaattgaaagacttcccccaaaaggaagtggtcttttcactacccttgccagaaacatgctaggcaccactgggctctgtttctgtcccctagaaaatgggaataaaatttcttttgctgtca

SEQ ID NO: 197833 - DNA, 4469 bp, Homo sapiens
  Payload ID: 19012
  Gene Name: U-box domain containing 5
  Uniprot ID: O94941
  ENST ID: ENST00000348031
  CDS Start-End: 473-1936
ttttgtatttttagtagagacgggggtttcaccacgttagccaggctggtctcgaactcctgaactcaggtgatccgcccgccttggcctcccaaagtactgggattacaggcgtgagccaccgcgccgggactaagctgcttaatgacttccagagcgatccatccaggaaggtgttttccctctgcaggtcctagactccccctgcctcctcaacaacgtcctccagtggaaaatgtccttgggaaacgctgacagagtcttttgagcctcggccgcatccgtcactcgcgcagcaggcggaagtagcgggcagttggccggaagtggggctgtgaggctcggagtcgccggaggagccagtatctgtgtcgccgccgcccgcggcgtccccggtttggtgttgcggcgcccaccttcgggaggatcaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacagagcagcctgggagcatcctgggccccgaatgtgcctcctgcaaaagagtattttctccctacttcaaaaaggagccggtgtaccagctgccctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgtttgggaaggaacagcctaaagatgctttgtaaagctgtattttacccttgagcttagccgcgggtccctgtgaaccggcacattcctttcctttaggccgtccagagctctagtccacacccaatactttagagatctgggtttggggttagttgcttttttttttttttttttaattgagacagggttggtctctgttgcccaagcttgagggcagtggtgcaatcataactcattgcagcctcgaactcctgggcttaagggatccttctacctcagcctcccaggtagcaggaactataggcatgtgccaccatgcccagctaatttttttattttttgtagagacaaggtcttgctatgttgtccagactggtctcaaactcctgggctcaagcgatcctcccaaagtgcttggattgcaggcatgagccacttcgcctagccaagcctgcatttttttgagttcctacatcatttgtccacaaagatggcttcagagaggtggtcacatgctttgctctgcttcctcttggcactgaccttgatgcagccttcacatgagatttgagggtccgcatggatggcctgtgccgccctcgctggcgaggctcctgtgtgcccctggctttctgggtctgtgcctctccagaatcttgtcttaccctccggtgtgcttgtgttcttagaaaagccccagcatggccgggcatggtggctcatgcctattatcccagcactttgggaggccaaggtgggtggatcacttgaggtcaagagttcgagaccagcctggccaacatggcaaaaccccatctctactaaaaatacaaaaattagctgggcatggtggtgtgtgcctgtaatgccagctactcaggaggctgaggcatgagaatcgcttgaaccggggaggcagaggttgcagtgagccgagatctcaccactgtactccagcctgggcgacggagtgagactccctctcaaaaaaagaaaaaagccccagcatgtagcaaaagcatttcttggtgagtgtgggggctggtgattcccaccttcaccctgtcatggtctcagggaacagcctgcttcccaccagcagcttgacacccacagtgtgctctggctgctgggagcccatctctcggagaaaccctgtccacccaaccccgagagccctagcgtgcagtcagcgtcagcacggcgctcccagatgagggccggactgcctccccttaagcagctgtgttggaggtactgcccagaccgctgcaggtccctggggatctgcatttctaacaggctcctgcccccaagactgctctggtggaaaatccagcctgggagcccctggagtggcaggccctgtcctgggtacaggtggagccacccccaggagttgcgtgtgtttttcttaattgaaagacttcccccaaaaggaagtggtcttttcactacccttgccagaaacatgctaggcaccactgggctctgtttctgtcccctagaaaatgggaataaaatttcttttgctgtca

SEQ ID NO: 197834 - DNA, 524 bp, Homo sapiens
  Payload ID: 19012
  Gene Name: U-box domain containing 5
  ENST ID: ENST00000449731
  CDS Start-End: 260-524
ccggaagtggggctgtgaggctcggagtcgccggaggagccagtatctgtgtcgccgccgcccgcggcgtccccggtttggtgttgcggcgcccaccttcgggaggatcagttagcatcgctccttcctctgcctggcccccctcctctaacttctagactctagtttaaaatgaagctattcggctctgctcagaccggtatgtggaagggagaaaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcat

SEQ ID NO: 197835 - DNA, 1291 bp, Homo sapiens
  Payload ID: 19013
  Gene Name: UBX domain protein 1
  Uniprot ID: Q04323
  ENST ID: ENST00000294119
  CDS Start-End: 133-1071
ggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggtatggctgcaagactagaaaccaggactagaaactgggggagtagggaggcatgcctaggaaaaggagggatgcaaagagaaggggctttgtgaacatggtgcaaggccaggaattttgggagcaaaaaccaagtatccttgtggttcaagcctgttttcttccatcttcaggactcgtgccttctgctgttctcattgtggccaagaaatgtcccagctgagggcctttgtcccattgtccctctgtgaccccttcatctttgataaagcactgacatctccttcctaataaatagaccctgagttctgtaca

SEQ ID NO: 197836 - DNA, 1153 bp, Homo sapiens
  Payload ID: 19013
  Gene Name: UBX domain protein 1
  Uniprot ID: Q04323
  ENST ID: ENST00000301935
  CDS Start-End: 168-1061
cgcttcccctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtaca

SEQ ID NO: 197837 - DNA, 367 bp, Homo sapiens
  Payload ID: 19013
  Gene Name: UBX domain protein 1
  ENST ID: ENST00000533000
  CDS Start-End: 2-304
gatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggactcgtgccttctgctgttctcattgtggccaagaaatgtcccagctgagggcctttgtcccattgtccctctgtgaccccttcatctttgataaagcactgacatctccttcctaataaatagaccctgagttctgtac

SEQ ID NO: 197838 - DNA, 943 bp, Homo sapiens
  Payload ID: 19013
  Gene Name: UBX domain protein 1
  ENST ID: ENST00000534176
  CDS Start-End: 73-943
tcggctttcttctcgtcggtgttcccggctgctatagagccgggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattg

SEQ ID NO: 197839 - DNA, 1110 bp, Homo sapiens
  Payload ID: 19013
  Gene Name: UBX domain protein 1
  ENST ID: ENST00000529640
  CDS Start-End: 143-1024
cggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggaacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttc

SEQ ID NO: 197840 - DNA, 1002 bp, Homo sapiens
  Payload ID: 19013
  Gene Name: UBX domain protein 1
  ENST ID: ENST00000616865
  CDS Start-End: 195-911
acgtgacccaaacagatccggcacttccgcttcccctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtac

SEQ ID NO: 197841 - DNA, 5571 bp, Homo sapiens
  Payload ID: 19014
  Gene Name: UBX domain protein 10
  Uniprot ID: Q96LJ8
  ENST ID: ENST00000375099
  CDS Start-End: 85-927
gggagaccagggttgtttaccagcaggacagagcccgggcgcaggcggcggatggagcggaacggctaggggtcttgagaagcaatggccacagaagcccctgtgaatatagcaccacctgagtgtagcactgttgtcagcacagcagttgacagcctcatttggcagccaaactcactaaatatgcacatgataaggcccaagtccgccaagggacggacaagaccgagtctgcagaaatcccagggcgtggaggtgtgcgctcatcatataccatctccgcctccagccattccctatgagttgccaagcagccaaaaaccaggagcctgtgcacccaaatctccaaaccagggagcttctgatgagatccctgagctgcagcagcaagtacccactggggcttcctcttctctcaataagtatccagtccttccttccatcaacagaaagaacctggaggaggaggctgtggaaaccgttgccaaaaaggccagctcactgcaactgagcagtatccgggctctttaccaagacgagacgggcaccatgaagacaagtgaagaagattccagagctcgagcttgtgccgtggagaggaaattcatcgtccgaaccaagaaacagggctcttccagggctggaaatctggaggaaccatcggaccaagaaccaaggttgctgcttgctgttagatcaccaacaggccaaaggtttgtacgccatttccggccaacagatgatttgcaaaccattgttgctgtggccgaacagaaaaacaaaacctcctaccgacactgcagcattgaaacaatggaggtgcccaggaggcgattttctgacctcaccaaatctctgcaagagtgcagaatcccccacaagtctgtgctgggcatctcactggaagatggggaagggtggccctgagtccacagccacccagctgaggtcctgggtctctgagcaaaggagcatgcttgggcgttgtggcctcttaggcagcctgtttcaagtgccatgtggacctggtgcagctgggaagcttgggactctcgtctgcactgcgtgtcctctgaagcagtgaagtctgtgcctatgccgagcgcgctaagaagtctcccttccagctgttccattctctccaccaccagcgtaactggcaagttaccaaggttgttcctgaaacagcagtgatcatgacttctcctttccagagttttgggtccttctgaattaatggtccttttcgaacaccggcttgcctttacagtgaactgtgattctctcgaagccaatgctttcctgtctgtatttgatgcaggattaaacacttcccagagaggattctagtctggtaaataaccacagtgtaggaactatctaactggcatttgtgtttcttgcgagtattttgaagaaacaggccgttgaccccatctttggaagtagccctttaccatgcatggtcagtttcttagggatttactatttgtgtgaggtggcatctaagggaagaatgggttttcttccccaaaacatcagcatttctaaaatagtcctaaagcttgaaagtaagttgcttccatgagcatggattacccagtagctactttttaatagagactgactaggtttacaacttctgggagctactctgtgggctgaattcttccaaaaccgagaaaagccagtgcagtctgatttcttttgcttttgtcagtaatggaatcttttgtttttaaaatgtacaaacctataagtttaaacaggtttgtactgacaacctccttggcttatttgggggtggagcaattgttttattccccagtttcagtgcgttgcccacttcaaacatggtgtgtcctttggagctgtgacagaggtgcctgttctgacttagaacctctggaggaggaggggggtgccttggtctcgtgttactttgctgtgcctgtgctgagagaccatgtgcccgagcatctggttgaccggcatgaagtacatcagcctgtcttagcctgagctgctttgaagaccatggggtcttgtgtttccaacttcgaagtgctgatgtggacagtttgccaatgttctcttctattgcaagttcagccagactccatgactcatctgatcccttttatggccaaatcatccttcagagtagggaacactcagacattctgtgcatgttgttcccccaaagcatggtcatcacaaagtcctgagttctggtgtgtgctcccgcctcctgggtatacagagagaaggcaggaatcaggagttccagaagcatatacatgtggctaccccagcaacaagcgcatcctgtgctcagataagctgcatggttgggagtgttttttctcgcacgttgaggcttagtggagatgggcaccactgccatttgctcagaagaaggctggtctggtcctaactgcatcccacactgcccagatcattctagaataggttatttctgaatgttttatagaatttcttaataccatcctggtttggtcagccattcctttgattggaaaggtcagctggggccagtggtgcctcaggcaggcccacacaactggccacctcttcccgttaatgaccacagcagacagaatttgagcccagcacctaaaagtacaggaatttcacttcccaccaggacttgagcacataactctatgtctgatctaggaggctgggggaagagcctcccataaaatcacacctactctgtggtaagaataaaatcccacccacctgggacttggtaatttctccagacaggaaagctttagaaaacttgagtgaaatggagcaagcttgaaggagttagaatcttctgtgcttagggtttgctgctgctggtgagcttagaattttggggttgggaaaaagtggaaggcataagcatagaaatattttaggatattttaggatatgtgaataaagctagactcaaaccatcataataaacattttttttttggacaaaagatgatacgataaaaaccaacttgtgtgaaactgagtcagtggagaagtgcatctcgtattttaacctaaggcttcagctcccacacacgactggacagaggggtgtgttagcctgatcttcagttttctcattgggaaagcacttgttccactgttagaaccaagtcctcctccccggacacttctgatgcccactgcagaagcgacggggctcctgctctcagcttctgtcacagcacttagcttgtctggataagagtcacctgaatttttcctaaacatcattccaagtactctgattttggggattggcaagaacaaactaaatcagaattcagagttcctgatggctccacatgttgcattgcagctgaggccccctgtcctaaatgggctcaaccggcctagcacactcctcttggtggctttgggtgggtcagccttgcccagtttggggtcatagacctcagttattcatttaaccgatggccattgagggcttacccagtgccacactttgagacaagcatgggtgtcctgaaaagaaagtgttggcaagaaaacatgaacccaccattggactctcaactcaaaccttactgaagtcagtggctatagctttatctgcaaaggaccccaaagtgaggatcccacattgttactgctggctcttcatcccaccctctggagatgctaaggaagctcttgcccaccttttctagtgatggagtaggaactttgcataggacaaaccttcatgataggttactctagtatattccctcataaagtccaataggtaaattagtcttggcagcagaaggaacagcaggagaagtaagtgattcatcatctagaatccagaaaatttgcaccaacagatggcaggtggttataacacaacagatcttgccctgagaatatctggggacccagccaacagccttcaaggcagggcactcctgcggaagagatggcttgtgaacatgactgtggacccagagtcaccccagagctcccatataaaatgcttcacagagaaactaagagcagccttggggcattcattccaattaataaccttaaagactagagccagatccacctgcattacaaaagcaggcattcgaggaactaaactttgcttttgttcatgctcttacctgccgttttaaatgggtttctaatgtcaaataaagccaccctgcctcttgggacaaagatgtttctctttacttagttttaaaaataaaatcctcataataagttcggataaaagagacttttacatggtaagaggatctacttttctaccttttaaacggaataaagaagacagctatattattttgctttagcattagtttagaagtcattccaagaattaagcaggaacatctgttttctcagtccattaaggcaacaccccacagtaaagttaaaagttcacgagcctattgactctcatccagaaaccagaaccaaccaaaccccaccatataacagggaaggcctgaggtcgcttcggaggagttagcaatcaaaggagaacagacttttggtgactcagttaccaacacacaacactcataaaactaaaattaggtgttttattttttgtctacacgggtggcgtgccactttcctttcctgattagggaagcttctcccagccctttctgacgttcatctgtgtgcctttatgttcaaacagtttaggaagcagcagccctcctaacagtcgacgcggaagcacaaatctctggaggtatttttggacacacttaaatcctatcccaagagactgaacgactgtggtgacaaatgcccacgggtaaaactgagcaagcctcattcagactgtcctgctcagaggcgccctctggctgccgtgttgaggggctggggtggaagatggaagacttgagtgctggaggtatgaaggtgaccagagagaggtgatggtggttcgggccagggtggtagccagagatgtcatgagaggtggccagattctggacatataatccattttcttaaggagaaaaaaaaggatagtttgacaagttgggattcacccaggtggacttagcttgaccaatatcgccaacgtggattgtttctgcaaaaacaaacaagcaaacaaccaccacggcagcaaagcacatggcaggcaggggaaagacactgaccagcaggaacattcccatcaaggaaatgcacgagtgtttttggacaaagtgtacagagaaaatcaaagctattcattgttttaattaagagataaaactaaggtcactgtttcacttaatgttgagatataagttaaaagtatcatctacctctaggggtatgatatgactgctgaccaaggttacttaataagaaatccttgttctagttaaatacactgtttatctctatctcctgtccttcatccctccctttcttgccacccttccctccatttattccagtccagcagctgactggggatgcatttcttcttgggaaggcaaacaaagccatcattctggggcttaattaataaagctcctagtttcatag

SEQ ID NO: 197842 - DNA, 2254 bp, Homo sapiens
  Payload ID: 19015
  Gene Name: UBX domain protein 11
  Uniprot ID: Q5T124
  ENST ID: ENST00000314675
  CDS Start-End: 81-1283
gacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctcaacccgctgctccgccaggctcttgggtgggccatctcgccaggcacgtaggaaaggcctgggaccagctgggccagggagggggcggtgccgacccgccccttggtaactcgagccccggctggcgggcctggctgctgggtctttgtcttctaggttcctctttctcccaagaagggctaagtggatcctgtgaagggagggatgcagtggggggaaggagctggccccagctgggtttacattctcagctgggacagcagagcctcactgtgtatgtgtgcagccagcagatacctgtgcacaggcacagacccaccaactcgtggggacacttcaacaccgcacaaagccattttgccactagacccatgcccccaaattagcagaactgcagctgggtacccacctcccatgatacactcattcttagccattgtgctccaacacaggcgcatgggatggccacactcactgacaggcatggagatgtgcactacacaccaaggcacaagcatgatatggacacatgcatgtgaactggagggtggcccacccagacatctccagaaaccactggtccatacaggtatttgtgtgtcagacatatccaaacacatgcactaacaaacacagaggtgacagtcacaagagaacagctcagccacccttcccacagagcagtctcagcacagtcacaactaccaaccttgcccagggcagggacccaggaggcccaggccacaaccaaccagacacagtgccaatggaacaggacatcatttaattgcctctagggtcctcctgggagagggactgcggggcctttggcagagctctggctgatggaaccaacagaggtgcccatcagccagtgccaggcaggatggcggccccaatgcttggctgggggcagccagcatttggggctgttgcttaagacaatttctgagact

SEQ ID NO: 197843 - DNA, 1555 bp, Homo sapiens
  Payload ID: 19015
  Gene Name: UBX domain protein 11
  Uniprot ID: Q5T124
  ENST ID: ENST00000357089
  CDS Start-End: 77-1540
acaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 197844 - DNA, 938 bp, Homo sapiens
  Payload ID: 19015
  Gene Name: UBX domain protein 11
  ENST ID: ENST00000374215
  CDS Start-End: 197-938
ggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgagcggtgacctaggcatccctgtctgcagaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtga

SEQ ID NO: 197845 - DNA, 1846 bp, Homo sapiens
  Payload ID: 19015
  Gene Name: UBX domain protein 11
  Uniprot ID: Q5T124
  ENST ID: ENST00000374217
  CDS Start-End: 368-1831
agtgcagccccagccagaagagctggaaggctgggcggccaggcccgctgtgtccccagttttcctgttggagtccatctgctgtgctctcaggagagaaggctgggtctctgggagctcacatcctgtatgccctccctccatgccaagcaactttggggagtcctggcagtggtgccaggcgttgctcttacctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 197846 - DNA, 1792 bp, Homo sapiens
  Payload ID: 19015
  Gene Name: UBX domain protein 11
  Uniprot ID: Q5T124
  ENST ID: ENST00000374221
  CDS Start-End: 215-1777
aaaccgcgtgacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 197847 - DNA, 2043 bp, Homo sapiens
  Payload ID: 19015
  Gene Name: UBX domain protein 11
  Uniprot ID: Q5T124
  ENST ID: ENST00000374222
  CDS Start-End: 466-2028
attattccacaacaccccttgggtgccccaacgcgcctagcaccctgtaagtgctccccagctgtggatacaggtttctctcagggcagcccgcaagcagtgcagccccagccagaagagctggaaggctgggcggccaggcccgctgtgtccccagttttcctgttggagtccatctgctgtgctctcaggagagaaggctgggtctctgggagctcacatcctgtatgccctccctccatgccaagcaactttggggagtcctggcagtggtgccaggcgttgctcttacctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctc

SEQ ID NO: 197848 - DNA, 1312 bp, Homo sapiens
  Payload ID: 19015
  Gene Name: UBX domain protein 11
  ENST ID: ENST00000374223
  CDS Start-End: 462-1295
cgctgcgggacggctagcggccctgcgtggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatggcatcatgatgttcgacgggcccttccagcccttctacgatccctccacacagcgctgcctccgagacatattggatggcttctttccctcagagctccagcgactgtaccccaatggggtcccctttaaggtgagtgacttgcgcaatcaggtctacctggaggatggactggaccccttcccaggcgagggccgtgtggtgggcaggcagctgatgcacaaggccttggacagggtggaggagcacccaggctccaggatgactgctgagaaatttctgaacaggctccccaagtttgtgatccggcaaggcgaggtgattgacatccggggccccatcagggacaccttgcagaactgctgcccattgcctgcccggatccaggagattgtggtggagacgcccaccttggccgctgagcgagagaggagccaggagtcacccaacacgccggcacccccgctctccatgctgcgcatcaagtctgagaatggggaacaggccttcctactgatgatgcagcctgacaacaccattggggacgtgcgagctctgctagcgcaggccagggtcatggatgcctctgcctttgagatcttcagcacattcccgcccaccctctaccaggacgatacactcacgctgcaggctgcaggccttgtgcccaaagcagcactgctgctgcgggcacgccgagccccgaagtccagcctgaaattcagtcctggtccctgtcccggtcccggtcccggccccagtcccggtcccggtcccggccccagtcccggtcccggtcccggccccagtccctgtcctggacccagtcccagcccccaataaagcacccgccccctcaa

SEQ ID NO: 197849 - DNA, 793 bp, Homo sapiens
  Payload ID: 19015
  Gene Name: UBX domain protein 11
  ENST ID: ENST00000423664
  CDS Start-End: 349-793
gacaacaagatggcggcgctgcgggacggctagcggccctgcgtgtactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgagcggtgacctaggcatccctgtctgcagaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccag

SEQ ID NO: 197850 - DNA, 728 bp, Homo sapiens
  Payload ID: 19015
  Gene Name: UBX domain protein 11
  ENST ID: ENST00000421827
  CDS Start-End: 325-728
gacctttctgcccctggagtccccacgcaggctggagcccgagccccgagggcctgcgagctccgcggctcccacaggagaggttcaagaccctgcttaccatgactacgcgtggaggcggaaggaggcgacacggcctccagggctgggttagatcgtgatagacgtcgctccctgagcgcgtcctgggggcattagggagtcctggcagcgggccggaccgtgtccccgccagagctctgggctctggggatgacggagaggccgaggaggtgtgaagaagaatgttggagttcctgacagctggattctagaagtagaactatgagctcacctttggcctcccttagcaagacccgaaaagtgcccctgccctcggagcctatgaatcctgggaggcgaggaatccgcatctatggagatgaagatgaggtggacatgttgagtgatgggtgtggctcagaagaaaagatctcagtcccttcctgctatggcggcataggtgcccctgtgagtcggcaagtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgca

SEQ ID NO: 197851 - DNA, 688 bp, Homo sapiens
  Payload ID: 19015
  Gene Name: UBX domain protein 11
  ENST ID: ENST00000442942
  CDS Start-End: 134-688
attaggaagagtagccagggaagtggaaacttcaggctaccccctgggcttggagccctgagtctgtccccaggggctgacttcctgcattcctctagggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtg

SEQ ID NO: 197852 - DNA, 782 bp, Homo sapiens
  Payload ID: 19015
  Gene Name: UBX domain protein 11
  ENST ID: ENST00000452980
  CDS Start-End: 161-782
tactttcccaagcaccaccaggccaaaggtctctcagttcagagcagaaagccgtatacccagaggagcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggggactcattggcgccccctgaggtggactttgacaggctgctggccagcctgcaggatcttagtgagctggtggtagagggtgacacccaagtgacaccagtgcccggcggggcacggctgcgtaccctcgagcccatcccgctgaagctctaccggaatg

SEQ ID NO: 197853 - DNA, 649 bp, Homo sapiens
  Payload ID: 19015
  Gene Name: UBX domain protein 11
  ENST ID: ENST00000450041
  CDS Start-End: 303-649
aagagggataattcctcccaagatcaatttagcaaaatagcggcactgtcgggatcacacattcaggtcctgaatgtgaggctgccagcagtttcattaacctaatcccaggctccttcctcccgcacctgagggttgctcaggcctccctcaaactagccaatgagaagtgcacgggtcctggtcgcctaggaaaccgcgtgacaacaagatggcggcgctgcgggacggctagcggccctgcgtggaggcgaggaatccgcatctatggagatgtccctgcatcccatgactcggagctgatggccttcatgacgaggaagttgtgggacctggagcagcaggtgaaggcccagactgatgagatactgtccaaggatcagaagatagcggccctagaggacctggtgcagaccctccggccacacccagccgaggcaaccctgcagcggcaggaggaactggagacgatgtgtgtgcagctgcagcggcaggtcagggagatggagcggttcctcagtgactatggcctgcagtgggtgggcgagcccatggaccaggaggactcagagagcaagacagtctcagagcatggcgagagggactggatgacagccaagaagttctggaagccaggtagagcagggcg

SEQ ID NO: 197854 - DNA, 6066 bp, Homo sapiens
  Payload ID: 19016
  Gene Name: UBX domain protein 2A
  Uniprot ID: P68543
  ENST ID: ENST00000309033
  CDS Start-End: 245-1024
ccgcgcgcgctcctcgggtctgcgcggagccggcgtcggcgcgcgcttgggcgcctggcgaagaccgagagaggctggcgggatctcagcggcgcggccgcggaacctgaggcggtctggggcggcggcgctccggctctgaagggctccagccaaacggagcccgcggccaaacggtgcctgcggtgcctgagctgagtgaggccgaggccgggaggccgtgcccggagtaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttctaaaaagcctattccctttccattttattttctttcaaaaattatggatttgtttttggctaacatttgggattagccattcatttgccaccactcacttagaatataatgccggtgtgtgtcacattactagtattttttaaatgcatcatataaagtatggttttctgtttctttttcgtttgtttgagatggagtttcgctcttgttgcccaggctggagtgcagtggcgcaatctcagctcaccacaacctccacctcccgggttcaagagattctcctgctcagcctcccaagtagctgggattacaggcatgcgccaccatgcttggctaattttgcatttttagtagacacgggatttcaccatgttggtcaggctggtctcgaactcccgacctcaggggatctgcctgcctaggcctcctgaagtgctgggattacaagtgtgaaccaccgtgcccagctggttttctgtttcatacatcagagtcaacttgtgaatacatttaaagattatttcattttgatatcacgaagaaaaacaggctttatatctcagactttaactaaatccagttagacctcaatttttcactgtcagattaaatccccatacctgaaaataagtttaacatttttttttgcaaatgatctattgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatgggccaggcacggtggcttacgcctgtaatcccagcactttgggaggctgaggcaggcggatcacaaggtcaagtgattgagaccatcctgtccaacatggtgaatccccgtctctactaaaaatacaaaaaaaattagctgggtgtggtggcatgcgcctgtagtcccagctacgtgggaggctgagggaggagaatggcttgaacccgggaggtggaggtttcagtgagccgagattgcgcccctgcactccagcctggtgacggagcgagactctttctcaaaaaaaaaaaattattcatttaaaaataacttctggctggacatggtgtctcacgcctgtaatcctagcactttgggaggccaagacaggtggatcacttgagcccaggagtttgagaccagcctgggcaacaaggcaaaactctatctataaaaattacaaaaattagtgcagtagctcacacctgtaatcccagcactttgggacactaaagcgggcagatcacctgaggtcaggagttcgagaccagcctggtcaatgtggtgaaaccatgtctgtactaaaaatacaaaaattagcctggtgtggtggcacatgcctgtaatctcagctactagggaggctgagggaggagaattgcttgaactcaggaggcagaggttgcagtgagccgagattgcgccactgcactctagcttaggcaacagagtaagaccctgccgtaataataataacttttttttttttgagatagagttttgctctttcccccagactagagtgcaatggcgcgatcttggctcactgcaacttgtccccccgggttcaagcgattcttctgccacagcctcccgagtagctgggattataggcgcccactaccacgcctggctaatttttgtatttttagtagagacggggtttcgccatgttggcctggctggcctctaactcgtaacctcaggtgatccgcccgccttggcctcccaaagtgctaggattataggcgtgagccactgtgcccagccaataataacttataaaacatgaaacgatttagtgagaaaagtggccggttttttggggggaattactttctgtcataaagaagatagatgggttctcatgtcttctacattcagtctgttgtgcagtcacatatcatgtagactctggaaaacacctctgtatactggtgaaagaatgaaaagaagcaaataatgccttagtatgattatgaaaaacgttttgacttcacagtgccctgaatgggtcttgggaatctccagggatccctcaggcacactttgagaaccaatctatataaagtgatggttcacaatgattctgaagccttagtttcagaatcatttggggcagcttttcaaaaatgccattcctgccacctaccacaaagattctgattcactgtatctgtgatgggtctcagatctctgcatttttaatctcacgtgattcttaagtatgtggtggaagtacctttcttcaggaaattctgtcctaagcttttaccctgagaaaataaaacctgcatgctttcaccatggacggtgggagactccactgaaacacatctgctagaccactaagtttatccttgtcacccagtttgctcttggaaagagtctgttcccttttgtcactgaaccaatcatgacataaacttgtgctttacctcctatagcacagccgagacaaggctggaacatttaattaaggtttttactaaggactcaggaataacaacagggaaatatctatgtaactagatgacctgacataaaatctatcttctgattgcagtctattgtgagaatgctgcttttcctagctcccagccttccatggggcagaaggctcttttaattaggaagagagggaggacaaaggagagccttttcttttgtccattactcttagaaatgaacaggtacataatagaaaataaataattattgttggtaatgtttacacagcagtgttagagcctctctgtagtgaaacaaaaataatgttcttaccaaaaaaaaaaaaaaaaaaaagaggcaatgataaaatcaatgagcttatctttctgatatagaaaataacaggatgacagttaatacatgttcaggaatctaagaaaatgtttcatataggcctatcatgtagcatttttatttgcataattatagtcaacatatgattctccatgtaggggtctctcattgagaatgtttcctgtgtacctatagaaaagcctctttggtagattttccggtttataattatttaaccagaagatacatgggaggttcttttgtatgtacctgtagaatacatcccagtaagggtcctatggagaaagacctgttgtcatcaataaccttcattattctaactgtgaaacgttcattaatgcgaataatatcctcaaagattttctacaatgagaatcatccagtaaagctttttaactgagaatttaaaagttgtaaaattgttagttaaatgtgtataattatcaaaagaggttgactttggaaaacaaacaatttgctaagggaaggaaaacttgaaaataatcaccttagatggggcatacaatttgacctaagcaattgtttcaaaactgtcttcagtttcttgaaaataattgttagggctgatatatagaaatacatatctaggccaggcacggtgactcatgcctgcaatcccagcactttgggaggctgaggtggatggatcacgaggtcaagagatcgagaccatcctggtcaacatggggaaaccccgtctatactaaaaatacaaaaattagctgggtgtagtggtgtgcgcctgtagtcccagctactcaggaggctgaggcaggagaatcacctgagccccggaggcagaggttgcagtgagccgagatcgtgccactgcactccagcctgggcaacagagcgagactccgtctcaaaaaaaagaaaaaaagaaatacatatctaatgttacagattgtggtttattggttaattactatgcatttttttcagtttaaaaaataatcttattttatatacttctctcggtataatttttcatgacatttcagcatgttgataatatgtgtgcatctatttcagtgccttaaagtattttgagagcaatcttttgctgacagttgaagaactgttaatgaaatactgttcattaaaaggatctgtgaaatca

SEQ ID NO: 197855 - DNA, 1557 bp, Homo sapiens
  Payload ID: 19016
  Gene Name: UBX domain protein 2A
  Uniprot ID: P68543
  ENST ID: ENST00000404924
  CDS Start-End: 442-1221
gaccagaaaagccagactaatcaggacgagttcgggcgtggaattgggcctgaagccctcatgcccagccaggcctgaatgccccagaccccaccgtcacccccgtggcctggatggagcaggggacggccggcgaaggcgcggggtggaaggggagcggcgacgaaggcgcgaggagctgactgggaatccccaagctacccgaggcaagacactgaacttgagtcgcacttttcatgcctgtagaaatgagaatgacagctgtgataaaaaaaaaattcatctgggcggtatctggaacttggcggtggatgaggagggctgctcgctggctgcggctgaggctcggtcaccgtgtagagaggcccagggagagctgcttcactcaagtcctgtcaagtcaaggcagccgggatttgtccacatctaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagtgccacaccaaaaattgtttctaaagcaaagaatattgaagttgaaaataaaaataatttgtctgctgttccactgaacaacttggaacccattactaatatacagatctggttggccaatggaaaaaggattgtccagaaatttaacattactcatagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcatt

SEQ ID NO: 197856 - DNA, 1821 bp, Homo sapiens
  Payload ID: 19016
  Gene Name: UBX domain protein 2A
  Uniprot ID: P68543
  ENST ID: ENST00000535786
  CDS Start-End: 247-867
gtccgcgcgcgctcctcgggtctgcgcggagccggcgtcggcgcgcgcttgggcgcctggcgaagaccgagagaggctggcgggatctcagcggcgcggccgcggaacctgaggcggtctggggcggcggcgctccggctctgaagggctccagccaaacggagcccgcggccaaacggtgcctgcggtgcctgagctgagtgaggccgaggccgggaggccgtgcccggagtaaggcgaaagagaatgaaagacgtagataacctcaaaagtataaaagaagaatgggtttgtgaaacaggatctgataatcaacctcttggtaataatcaacaatcaaattgtgaatattttgttgatagcctttttgaggaagctcagaaggttagttccaaatgtgtgtctcccgctgaacagaagaaacaggtagatgtaaatataaaattatggaaaaacggattcaccgtcaacgacgatttcagaagttattccgatggtgccagtcagcagtttttgaactccatcaaaaagggggaattaccttcagaattacagggaatttttgataaagaagaggtggacgttaaagttgaagacaagaaaaatgaaatatgtttgtctacgaagcctgtgttccagcccttttcaggacagggtcacagactaggaagagtaagccatatcaaagacttcattgaaaaataccaaggatctcaaagaagtcctccgttttccctggcaacagctcttcctgtcctcaggttgctagatgagacactcacactggaagaagcagatttacagaatgctgtcatcattcagagactccaaaaaactgcatcttttagagaactttcagagcactgatttttgatagactaagtggaaaatttgcagagaaatgatggttgtaagtggacatgcaaaccaaaattggggattggagaagtcagactcactagacttttggttcgagtactattgaactctctcctgatgagaagatgtttagataagtacaagttaagaaagtagcatatgactggaaactatattcagtgcactttctccaaaagactacccagaaaaatagacttattttcaaataccagttatcaagatatattaaatagctgtattgtttagaatcttaatatggtataaattagcatatgtattcacaatattcattcagacatcattcccagacagcagggatttatttaaatgttagctgtctgagtttttaaatagctaatacgaccgggtacagtggttcatgcctgtaatcccagaacttcgggaggccgagacaggcagatcacgaggtcaacagattgagaccatcctggcaaacatggtgaaaccccatctctagtaaaaatacaaaaattagctgggcgtggcggtgcgcaactgtagtcccagctactcgggaggctgaggcaggagaatctcttgaacctggcaagtgtaggttgcagtgagctgagattgagcaactgtactccagcttggcgacagagcaagaccccctctcaaaaataaataaaataaagtaaaataaatataaataattgtggccgggtgcaatggctcatgcctgtaatcccagcactttgggaggctgagatgggaggatcacttgaagccaggagtttaaaaccagaatgatcaacagagtgagacccctgtctatatatttttttaatttaaaaaataaaagaataaaattgtgtagctcagtatagtatcaagattaatctgcctactcacatttctacactttataaaaatgtaataaaagaaaattatctttct

SEQ ID NO: 197857 - DNA, 5068 bp, Homo sapiens
  Payload ID: 19017
  Gene Name: UBX domain protein 2B
  Uniprot ID: Q14CS0
  ENST ID: ENST00000399598
  CDS Start-End: 123-1118
ggttcgggtagcggggacgcgcacgcaccttgcgcgtcttcgcccctcctgcggttgccaggcaaccggccccggaagttgcggcaggtgcgtccgcagcgggcgccgctagccagcggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacggttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggagagattcccctggagcttcagcgccttgttcatggtggccaagtgaatttggatatggaggatcatcaggatcaagaatacataaaacctagattgaggttcaaggcttttagtggagaagggcaaaaacttggaagccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaaattatttttattatttttacagataaattttggttttattgttattctgtcttccaatctgaatatagacaaatttggattaggaatagaccttgagataagtatgtttgagtttttagttgaaggactggcttatgttgatagtttttggatttctaggcaaatgagttgttacatgcttagtgttaatgtaacaacatttgtttgcagagaaaaatgaacaaaacccctttttgataaatgcatttggtaaaatttgcactaaagtttcttgatgcagcattgaccaacagccattaagaaatcttttgatcaaataagttgaaaatttgtctataatatatactgaaacgtgtcttttgattttgaaattgtttgatcatacaataattatttctcctattaagattttacacatcctttttacttactgatttagatatattactagtatcagaaactacagttttgccttgtattttacagaattatgactgttgtgaacttaaacagaaacacataaaggtcagcaattctttttttttttttttttgatatggagttttgctcttgttgcccaggctggagtgcaatggcataatttctgctcaccgcaacctccgcctcccaggttcaaaagattctcctgccttagcctcccaagtagctgggattacaggcatgcgccaccatgcctggctaatttttgtacttttgctagagacagcgtttctctgtgttgatcaggctggtctcgaactccgaacctcaggtgatccacccacctcagcctcccaaagtgctgggattacaggcatgagccaccacgcccagcctaaaggtcagcagttcttaagaagatatggtaaacagcaacaatattttaaaatcaagtaattacagttcctcccagagcttgcgttgatcacattcatttattcattcaacacatttttctaggaaactcactgtatacactaaacactattctgtgtgctcaacctagaatgtcttctccagaacaagactagtgtagaaatacaggaatgtaaattctgtcagacggactagatctaaagaattaccagcataaatgtttgcatttctgctgaagccagaagcttttccttcttcctagacaccatttcatccttaattattacttctggttagttttccattgccaccataacaagttacaaaatgtggcttaaaatagcacaaatttattatcttcacaattctgtaggttaggagtccaggttaagagtttcgcggtgccaagatcaatttgttggcagggttgcattctgttaggaggctctacaggagaatcatttccttgtcattccaccttctacaggacatcctcattccttggcttgtgacctccttcttccatcttaaaaaccagtgctgtttcatctctatgacccttctgttaccacatctctctgacaccagtgtggagaggttctctgcaggactcatgattaaatgaggcccaccggatatccaatctaggcttatctccttgtcttgaaatccatagtaaccttaattacatctgcaaaatctcttttaccatctaaggttacatacaggtttggagattaggacattaacattttacatggaacattattcttgcctactacagttcccacccaccccccgctccactcctgtgttaaagattcagattcatcacaaataaatttacatcactcataggtgctcaaaagtcacaatccattattacagcatcaactctaaatccaaaatcttatctgagtctcaccaactcaaaagtctcaaatctcacattgaagccatctaaattaagtttgggagaggatctgtgtgtgatttctgggacataattccaactgtgcacttgtgaacctagaaaacaagttatctgttcccaagtatgatggcatgacaggcagacaataatagttacacacgttcctgttcaaaaagcagaaacagatggaaaaaggagccatcagcaccaatcaatttacaaaaccagcgaggcacccttctttaagtttcaaggcctgggagtaatcttcagctcactgctgttctctgggcttgttgactgtctcagagtcatctttactttttcacaaaaggtagcacacgtttgcagctgagtatcaacttatcagtttgttcttcttttatattctctaaagctttctgttaaaaatggtggtgcttctgctgctataacgttgtcaagaaacttgtgggtcttttacatatgtcacagggatgcactcatttagataggaggctcctcacgtatctttcctggaaaatcctgtctctgtttttggctttttctgaaatagctgagaggatctatgattcacacccttaatatcttcaaagagtcttgtgtgtgacctgatattcagaccttttgatgtttctgaagtattagcaaaaggttatacagccatatcttcatcactttctctagagtaaaggctgtcctgacggtgaatcttagttttagtggcttttgccatttgaataggccgcgaatttcccaaatcatcaagtcctggtttctttatatttaacaggtcttccctcaatctacctctttccacattttactataatcagcaagaagacagcaggctgtaccttccacagcttgcttggaaatatcctcagctaaatattgaagtcatcacttaaaagttctgctttacacataacggcaggacacaactcagcttagcttttcgccactatgtaacaaggactcctttcctccacttctccagtaacatattcctcattttttaccaacagtctattcatgatgatttagatattctatggcaatcgaggtattctctattatgctcctttcttcaaggccgccctagcattaacattccatatttctactaacagtctgtttaaggcagtttagcttcttttctggcatgctcctcagaattcttccagcctccacctactgcccaattccagagccacttttctacttttaggtatttgttacagcagcacctcaagtacctagaaaactcttttatgcctgcttctctgccagatgacttgaatatggtactagatttggaattcacctttctccagggtcactgtttatttcaaagaggtgaatttacctgtgctagggttttcacactgggagtgctaccagaactaccacaggatgaaagtggtgagcccaccactgcagagaagttttctcagtgccgtaatatagaggaattctcaaaataagccctactccttttcacttactgaaaacaacttggataatgtgtaacagccagccccatttcaaaaagattaccaggggtaaaacaactttttcatgggtcaaaatcatcttccgaagaaaatgatttcttaaaagaattgaacattgtaaatcaaagggcattgtcctgttttggattaacaaaacaggaaaaataaccaatccttgtaaaattatttgaaattttcttgtttttatcagttgagtgcctatagatgcacatacaaaaacaactgccatttttgtatataatagtcttccaagatagagatttacattaggagagaattaaacatccaggagggatgaacagtatttcatgtgtgctatgtagtgttttgcttcattgagagtcattttcatgaattatttttactactgcagtcatcttaaatttataatcatctcaaaaaagatgtcacaatgaacagacaaccatctgtgaggtcagtcattttgcatgatgtatgtaatcaaaaagtttgaaatgtctgcttactaataaagaatgttttcactgaaactta

SEQ ID NO: 197858 - DNA, 684 bp, Homo sapiens
  Payload ID: 19017
  Gene Name: UBX domain protein 2B
  ENST ID: ENST00000520732
  CDS Start-End: 6-320
ggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacgtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggagagattcccctggagcttcagcgccttgttcatggtggccaagtgaatttggatatggaggatcatcaggatcaagaatacataaaacctagattgaggttcaaggcttttagtggagaagggcaaaaacttggaagccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacaca

SEQ ID NO: 197859 - DNA, 618 bp, Homo sapiens
  Payload ID: 19017
  Gene Name: UBX domain protein 2B
  ENST ID: ENST00000521796
  CDS Start-End: 1-427
gagcccacggacaccacctcaacggttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggggtgactctcattgcatgtatgcctgaaattcagcaacttatgttagaaatcttttaatgtggcattactgctggcagaagatttcaaaaggttagtttgaagttataatttgtgaaagtaaactcagatattcagtgctctcacccatccaaagaacattgtaacttaccagctcttcttgctaaaggatgaggaatcaagtgattttgctatgataataaaagcttttctgtgttatgattaaacta

SEQ ID NO: 197860 - DNA, 1225 bp, Homo sapiens
  Payload ID: 19017
  Gene Name: UBX domain protein 2B
  ENST ID: ENST00000523409
  CDS Start-End: 6-596
ggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacggttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggggtgactctcattgcatgtatgcctgaaattcagcaacttatgttagaaatcttttaatgtggcattactgctggcagaagatttcaaaagagagattcccctggagcttcagcgccttgttcatggtggccaagtgaatttggatatggaggatcatcaggatcaagaatacataaaacctagattgaggttcaaggcttttagtggagaagggcaaaaacttggaagccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaaattatttttattatttttacagataaattttggttttattgttattc

SEQ ID NO: 197861 - DNA, 4006 bp, Homo sapiens
  Payload ID: 19018
  Gene Name: UBX domain protein 4
  Uniprot ID: Q92575
  ENST ID: ENST00000272638
  CDS Start-End: 312-1838
ttcctccacttcctggactgcgcgaccggaggcctagcgggcgcgcgcccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattat

SEQ ID NO: 197862 - DNA, 1255 bp, Homo sapiens
  Payload ID: 19018
  Gene Name: UBX domain protein 4
  ENST ID: ENST00000416538
  CDS Start-End: 63-350
ggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctgtatcctttcagtaaagaatggcttatatatatacatttatttaccttccttttggttaatttatgaaatttagaaattattcatttttatttaggaaatcatacattcttttttatggaaactttattactaagtgtcctcatttaaaaaaaatgttattataggaaatttcaaacatatataaaagtaactcaatggtgtagtgcaccccatacattgagataatatattgcagctaaagataggatagggagtttttaaaatgtgaatatctgaaaaacaatatagatcagttgggttggaatgttacaagtagcttgcaagaggcagctggcagcaagatggatagaaaaggaagttatgatagaggagaatgtagtagattcttcactagaatatacctcataaattaacatgtcacatgtattaatactacaggtataatgatgcagtacttgaaattatttaataaatgttagattatattgtgaaaatcacaaagatcatttgttttcctttgttaccaatagtgtttcgtaaaactatcctttcgtttcacatgaattgttagacttcattaaactgtacagatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaag

SEQ ID NO: 197863 - DNA, 548 bp, Homo sapiens
  Payload ID: 19018
  Gene Name: UBX domain protein 4
  ENST ID: ENST00000415164
  CDS Start-End: 197-548
gtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcagacggtctcactgtgtcacccaggctggagtgcagtggtgcaatctccgctcactgcaacttccaccttccgagtgcaagcaattctcctgcctcagcctcctatgtaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttct

SEQ ID NO: 197864 - DNA, 568 bp, Homo sapiens
  Payload ID: 19018
  Gene Name: UBX domain protein 4
  ENST ID: ENST00000426921
  CDS Start-End: 145-342
gtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacc

SEQ ID NO: 197865 - DNA, 1943 bp, Homo sapiens
  Payload ID: 19019
  Gene Name: UBX domain protein 6
  Uniprot ID: Q9BZV1
  ENST ID: ENST00000301281
  CDS Start-End: 126-1451
tttttttttttttttttttttttttttaattttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 197866 - DNA, 1809 bp, Homo sapiens
  Payload ID: 19019
  Gene Name: UBX domain protein 6
  Uniprot ID: Q9BZV1
  ENST ID: ENST00000394765
  CDS Start-End: 155-1321
ggagtatagggcttgaactgagagcctggcctcccagaaggttttaatagacctacggcacagaaattgacacagcccggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaa

SEQ ID NO: 197867 - DNA, 403 bp, Homo sapiens
  Payload ID: 19019
  Gene Name: UBX domain protein 6
  ENST ID: ENST00000592515
  CDS Start-End: 15-403
gacccagatatcggatgaggccgggggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagt

SEQ ID NO: 197868 - DNA, 803 bp, Homo sapiens
  Payload ID: 19019
  Gene Name: UBX domain protein 6
  ENST ID: ENST00000590466
  CDS Start-End: 1-203
gcgccaagctggacaggcagcgccgcgtcttccagccctcgcccctggcctcgcagttcgaactgcctggggacttcttcaacctcacagcagaggagatcaagcgggagcagaggctcaggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgaca

SEQ ID NO: 197869 - DNA, 1613 bp, Homo sapiens
  Payload ID: 19019
  Gene Name: UBX domain protein 6
  ENST ID: ENST00000591919
  CDS Start-End: 1-1114
ggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatatagtttctt
